United States Patent 11,549,145 (METHODS AND COMPOSITIONS FOR INHIBITING AND TREATING NEUROLOGICAL CONDITIONS) - sequence listing, part 108

SEQ ID NO: 1994 - DNA, 932829 bp, Homo sapiens
tgtgccaagttcttagtatacacttcatcatattttaaagtaggacgtgtttatctgtccttaaatattaggcatcaggctcacgcctgtaatcccggcactttgggaggccgaggtgggcagatcacaaggtcaggagattgagaccatcctggctaacacagtgaaaccccgtctctactaaaaatacaaaaacttagctgggtgtggtggcgggtgcctgtagtcccagctacttggaggctgagggaggagaatggcgtgaacccaggaggcggagcttgcagtgagccgagatcgcaccactgcactccagcctgggcgacagagcaagactctatctcaaaaaataaaaaataaaaaataaatttaaaaaaataggcatcaggagggtaggagctctttttatggctccctgtgtttaacacaatgctgggcacaaaatcaggttaagattcagagggtttcgacagccaaagctattgaagggaatggcattttatacacagtatagatatccatacactggaaacacttttctggggattctgacatccatctcagcccttgctgagaactcttagctgaggggccatgaagcctgggtgctcgtgtgaaactgcaacttgcagttgactttgagggagtctcagtgcgtctccaggctccatctcctcatctgtgtaagagaagtgaagcccaatctgtcctgcctagtttcccctgggtttgttctgaggatgaaagaagatgctgtgtgtagaaccaggtcataatctggtaagtgctcaacagacgtaaggtcctgggataacatacacttgttttgataattacaacaagattcctcaggcagcctttacttctttcctagactgtgcccgctacacagtttcttcattcagcacctgcctcattctctcatgttgttttttggagacagggtcttgctctgttgcccagactagagtgcagtggcacaatcatagctcactgcagtctcaaactcctgggctccagcgatcctcctgcctcagcctcacaggtagctgggactacaggcacgaaccaccacacctctctaattttttaaaaaaatttttggtagagatggggtcttgctatgttgcccaggctggtctcaaactcatggcctcaagcaatcatccctccttggcctcctgaaaggctggaaagccactgcatctagccctattcattttctttctttccgagacagagtctctctctgttgcccaggctggagtgcagtggcacaatcttggctcactgcagcctctgcctcctggattcaagtgattcttgtgcctcagcctcctgagtagctgggatttcaggcaaccatcaccatgcccagctaatttttatattttttgtagagatggggtttagccatgttggccagactggtcttaaactcctgacctcaggtgatccacccagctcctaaagtgctgggattacaggtgtgagccaccacgcctggccccattcttttaaaaatatcagtggcttccatctattagaagtaggttgggctatacatcacactatccctaaatcttactttcatgtggtttgtttaataattaattcccaataagtctcaggggagagttctgcaatatgtataaaactttggcaagatggcatattaggaacagctctggtctgcagctcccagcgagatcgacacagaaggcgggtgatttctgcatttccgactgagggaaattgatattagggctaatatcaagaatctacaaagaacttaaacaaaattacaagaaaaaaacaaacaactccatctactgccttgagtgggcagtaggcaagctgaggcctgggtttctaagtggtcgagaggaggctggagaccagcaggggtcagacgctgagacgagacagatttaaccctcatcacaattttgctcaagtcctggggttcctgccccaccagtttccttttcggaagcctgaaaacataaaccaggtttaccaacaccctcaattcgcaaccagccccttctctccggtggatgtgtttgggaagccaggcatagagaatattgccattgacctcctcctgctcctttccttgtcccgctttattagcatcacatgaatttgatgggtgtgttgccgaagccagaataagtagtttagacggtgagggcagcagcagctcagagaagggagcagctgaaaaacctcagggcttgtgcaccacctcttgaggccagccagccttgccctgtctccaggcagctgtgctcctaaaccgcgacaaatgactaagaaatttctgctcaggggagtcctgagggaaggaaggtgctctttccctgcaggtgcatttgacgtcactcaggcacagggggcccctcccagcagcctccagaagcagcctccagagcctgggtcggtgacagcccgtctagtatttaagcatgattcagccaccctccctactcccgtgtaaatccgtggatatgcacggaatccagcttcctctttctgcacatacacacatccttttggctatttctctggaggaccctgactaacacaggccaccgaccctccatcactgtgggcttcctgtttctgcagtaagcactccctttgggagagtccaatgagaaaaaaggaaagaacctcattaggtccctccacgtcaacactgactgtgttaaccctaattactgcacctgaattattcttttccagttgcaaagaaggaaatctctaaggtcttttttaaaacctacaaaacttctaaagaatggtaaaatgggaaggcttttttgcattggcaggagcataaataattcctgagggcatctgaactccaaccaggtcagcccagcccagcttccccaacatcccccttgccagggaagaggcagagaatagtaactcaagtttatagagactgtattgttgcctttgatcttcagcaccaccccattgaggtaagcattagctcatacctttggacaagggcaagtcagaaagtgagagggaaagtgagaaaggcatttggaaaaaacagggaggaggacttggtcattgcttcattcatgtattcattgcacaaatatttattggctaccacaatgtgtcagctgtggtgctggaagtggagagacaatagcaagtgagacagagaaggtccaaacctttacccaacggagtgtatagtccagcaaacatttcctgaaggcctgcacctggcaaggcactgctggcaaagcccaagagtacagcaacccagcttaaaggagggtgatccaactttgaaagctgccccttctgtgagcgccctcaatccctcaagcttattctgcctcactaatgattgctctcccttccatggtctattgtaccatctttctctccctattggcctgagagctcttccagggcaggaccactctccactcagcccaacacaatgtctggcgcacggttcttcaggcacattcatccaatgatgacctgcaatgagccgagcatggtgtcagcagctgaagcaacagagagggaagaaacccaggccccttcctccagggatgtggagtctagtgggggagaaagataaagaaagaagcaactattttgatgtgataaatttcctggggaatgactaagtgccaagctgtgcagaagaagaaatgctggctgggcctggtggttcacacttgtaatcccagcactttgggaagccaaggtgggaggattgatggaggccaggagtttgagatcagcctgagcaacagagcaagactccatctctacacaaaattttaaaaattagccagctgtggtggcacacaactgtagtcccagcaacttgggaggctgatatgggaggattgcttgagccccggagttcctggctgcagaatggccactgccctccagcctgggcaacacagtgagacctagtctcaaaaaaaaaaaaaaaaaaaaaaaaaaaagccaaaaaggagagaggagggaggagagaaaagaggagggaggaaggggaggtcaaggaaggaggaggaggaacatagctgtaatgggaagatagggaggaaaaaggaggatggaagacatgctcagatatgtcttcatggctagatggtaagttctgactgggcagagacaatgtctgtttccttagtacctagcaaagggtcttgcactgggtagatattcactgtattttcagtggggaatgaattcccataatagggaatctgaagcccttaaagaaaaccagaatagcaaagaatagaataatgtttactcttttatattgattagaaatgcatactccacatatagaaagtacaaactcaacagagtaaaatctcagagaatggtttttacacatatttgcagtgtgatcagtcaatgttcctgaaagctaataagaatccagtaaccatttaatattaaatgtatggagaagctacctaaatcctagggtcatgttgcttgtcacttgagagaacaccattttcttgtctaactcttatttttattcacattcatgatcatacatgcatgtgcagccacacgaacatcaacatcaatatctggtttctagagtagattctcaaaaggtaggaaaacctgccttgatagcatcttataaaactcagcacattaccacacacagatgcattccaattgtgaaatctctcaggacgaaaagtattctatgggtgatgctgtttttcttttttttcccaggttttgcttattaatgacccagccaggctttctcacattgtcttgtgctagaggcattgactcctcacatcggaaaagtaaaatgcctagaaatgcctaaaggagaaataaaacaaagtggttgatgcttagaaagaaaagtcatccaattcactcacagtgggtcatgctgcttaactcagccacaaggaaatcccaattcatgcaaaaataattctgtcttcattattctacaatccagtgggtgtctatgataatttgagtactcctttcttgaaaagagaagatcagcacgtgtgtctttaacaatacattcctcttggtcttgctgaaatgctgcattagtgactgcatctgattgcactggaacctggctcaggccccctactgatgctcttacaggccattattaatgcgtaccccttcaggggctgtaatttgggactcaatttgccataaaattgtcctaagtgtcaccttagtaatcggagatcacatgacccatgaaacacattgagatgaaagatggcacctcttggaaatgaatgtcaaattttcccccatagtaaaaaggcactagccattgtatttgcagtggatttcactgtgccttgagatggggaggggttacaatgttccctgtgcacatgccttgagctgggcctgctaggcctcagaccagagccttcacctaccacataccctgaagactcaacacacagactctagtaattcagccatccctcaggtggattttgatggtgcttatctttttaaccaaaaatccatatgttttctaacaaaggagttttatcctaattccagatacaaaaagtaggttagatgtcaagtctggcaaaacaaaaggtagtttgattaatcattagggaaatgccaatcaaaaccacaatgagacacaatttcacacctatcaggatggctatttccaaaacaaacaaacaaacaaacaaacaaacacaaaacagaaaatcacaacggttgacaaggatgtggagaacctggaagccttgcacgtggctagtgggaaggtaaaatggtgcagctggcgtagaaaaacagtatggcagctcctcaaaaaaaggaaacccaggatcactattaacatgtgatccagcaacttcacctctgagtacacaacccaaagaaccgaaggcagggacttgaatagatacctgtgtatcagtgttcatagcaacactattcacaatagccaaatgacagtaataatgatctacatgtctactggcagatgaatggataaacaaaagcggatacagacataccatagagtgtcattgagtcttagaaaggaatgaaattctgacacatgctgaacatttgcccatggatgaaccctgaagacatgatgctaagtgaaatcaaccagacagagagagacaaataacgtgtgattccacttatacaagatgcggagagtagtcaaattcacagagacagaaagtggagtggtggttcccacggtggagcaggggtcattgttcaatagtatatagtttcagtttgggaagatgaaaacatctgaaaaatggatggtggtgacggctgaagaacaatgcgaatgtacttaatgccactgagctttctattttaaaatggttagaatggtaaagcatacattatgtaccttttataacaaaatgttttaaggtagattggttgtcaaaatactagaatttcacatttcaatggacgaaagccaaaacgaatgcaatgtgggactgccctggaaaactccaggcatttggacggccatcttgaaactgtgctgtagataaggtagatcaagaccaggaagccctggggagaaggtggcagggatatagagctggagagaaggggaactgtctgcctctttccttcagaaaagcctgcggtgacaacttgttcacctctagccttactgctcgggctgcagaggacgccggcaccagcacctttgtccatctcaagggctctgttggaaacttgagtcaaatcaactaccttgcagccttaatctatagtagttatttttgttgttccttctgttcctggtgacacttggttctgaatttagtctagcagaatgagagggcctgcacaggggccctgctataagttaccttcactcacaaaatgcgggcatccccacccctagttacaacacacatgtagcaacatgtcttcgtatgttctaaagcagaggaaagagccaatggaacttataagctgtagcttataaagcactcttagatgattctaccattttttaaaaaaaattaccatgatttatctggtcatctagaggggccagacacagtatgattatgatgctcttatgaacttcagagcactcctagaggccacttttaatgaagtacaagcctcctgactggagattaagtcaatatcctttatcacactattgaaagcactgaatattttggtatcgactctcactactctatttcaaaagaggctgaagaagctgaaaagctgagcagcacttctcagtttcaagaaactaggaggcaaaaactggagtctaggactcatcaatgagggcctaataattccctccattttggggctgagatctcaaagaactgtaccctaggactaagggtgatggaagtcgactaaaactcagcaacaaattatctcaattcatgaagtggaattaaggtgatcaagactgctagtctgggggaggggtggagcaaaatggctgactacaaggctccactgattgtccccacagcaggaatgccaaattcaacagctatccacataaagacagcatctttataaaaccaacaatcaggtgagcactcacagtccctggttttaattctatcactgaaagaggcaccaaggaaggtagcaaggagagtcctgaattgccagtgccccacttcctccatcgcccaacagcggccatgtggcacagagcaagaacctgtgcactcaggagagacagcacagtgattatgagactttacactgaactcagcactgccctgtcacagtagaaagcaaaaccagactgaactcaactgatgaacgcccagggagggagcattcagatgggcccaagctggaggggaaccgctgtccccgtggggggaatctgagttccagcaagcctcaccaccatgggctaaagtgctctggggccataaataaacctaaaaggcagtctataccacaaggactgtaactcttaggcaagtcctagtgctgagctgggctcgaagccagtgggcttggggagcatgcgacctactgagacaccacccaacacagctaaaggagtgtttgcaccagtccttccccaaccccaggcagcacagctcttggctccaaaagagatccctccattctgcttgaggagaggggagggaagagtaaagagtaaagagaactttgtcttacatcttgggtaccagctcacccaaagtaggatagggcactagtcagagttgtgaagtccccatttcaggtccttcctcctggatgacatttccagacacacccagggccaaaagggaacccactgctttgaaaggaaggacccagtgctatcaggatccatcacctgctggctaaagagctcctgggtcctgaataaccagcagcaatatccaagtaatatccaggtggtggtagccatgggctgcctgtggaaacgggacgaaagagtgggaagagctgggactcatggtttgagtgccagctcagctgcagtagaatagaacaccaggtatatttctaaggattttggttccagtacgtggctcctggacagcacctctggacctgcccagggcctaagggaacccaatgccctgaagagaaggacacatgcctggttggcttcaccacctgcttactgtaaagccccagggcctcgagcaaatataggccatagccaggtagtgcttctagcaggccttgggtgaaactcactactgtgctggcttcaggtctgaccagtgcagccccagtgatagtggccacaggggagcttgtgtcacctcacacccaactccaggtagctcagcacagagagagagactatgtttgtttgggagaaagtaagggaagagaacaagaatctttgcttggtatccagagaacgcttgcagatcttatccaagaccacaaaggtggtacctctatgagtctgcaagaaccacagtgttaccaggcttggggtgccttgtaatacaaacatgacttagataacacacccaagtcctttcaaatacctcaaaagccttcccaagaagaacaggcacaaacagcccagattgcaaagactataagtacctaactcttcaatgcccagacaccaaagaacatccacaagcatcaaaaccattcaggaaaatgtggcctcaccaaatgaactaaatcaggcatcagggaacaatcccagagaaacagagatatgcaacttttcagacagagaattcaaaacagccattttgaggaaactctgagaaattcaagataacacagaaatggaattcagaattctatcacataaattgaacaaagagattaaaataattaaaaagaatcaagcagaaattctggagctgaaattgcaaatgacatactgaagaatgcatccgttattggccttaaagaggaggtagagaaggagatagggatagaaagtttattcaaagggttaacagagaacacctcaaacccagaagatatcaatatctaagtaaaagaaggctacagaacaccaagcagatttaactcaaagaagactacctcgaagcatttaaaaatcaaactcccaaaggtcaacaataaagaaaagatcctaaaagcagcaaaataaaagaaacaaataacccattggagtttcaatatagctagcagccgacttctcagtggagaactgatagtcgagaagagcatatttaaagtgctgaaggaaaaaaacttttaccctagaatagaatatctatcgaaaatatccttcatacatgaaggaagaatactttctcagataaacaaaggctgagggatttcaacaaagactagaactgtcctacaagaaatgttaaaggaagtatttcaatcagaaagaaaaggatgttaatgagcaataagaaatcatctgaaaatacaaaacttactggtaatagtaagcacacagaaaaacacagaatattaaacattgtaactctggcttgtaaactactcttaccttgagtagaaaagactaaaagatgaactaataaaaaataataactacaactattcaagacatagacaatacaataatacatacatttaaaagttaaaaatatataaatttaatatataaatttaaaaagttaaaaaacacgggatgaaattaaagtgtagttaacctaaccattattaggattttttgcttctttgtttatgcaagcagtcttaaaataatgggtaatagatattatttgtaagcctaatggtaacctcaaatcaaaaaacatacaatggatatgccaaaaataaaaagcaagaaattaaatcctaccaccagagaaaatcactttcactaaaagaaagacaggaaggaaggaaataagaaggagaagaccacaaaataaccattgcattgggcctgcctgggtggtccgtgcaacccaagagagtgaggaaaagcagggtggggcaacagcccacccttgagcggggtggaaccaggtgagccctcaccccaggcaagaaaggtggtgagtgattgtacaacgcccccccaggaagccatgcttttcccatggatctttgcaacccgcagatcaggagatccccttgtgcacccagcaaggccttggttcccaagcacagagctgtgtgaactctcgcagctgcttggccatgcacaaagacccaggagtttcttgcatactccaccccgggaattccagtgagacaggagatcttccaagctttcccctaggaagggggctaaagccaggacactaagcagcgtcatcctgcaggccccactcccatagcacctcacgagttaaaacccactgacttggaattctagccagcctgtgggagcaggctggagattgccggagatgaccaagttcccagggggaggggcagccgccatctacatggctcaagtcagccattttggcctgccaactccaggagtctgcaaggtccagaccaaaaggaattcagcgccatgccgcgcagccagctgctgtggtagatcgcggccaggctgcttctttaagtgggaccctgacccatccctcctcactgggtggggcctccctgtgggaatttcataactccgatctctccctgggatggagccactgtggggaggggcggccaccgtatctatggttcagcctgctggctctggaaagtccaggtgatctggaaaagaggggctcctcccactgcagcacacctgctctgccaaggggcagccagactgcttctttaaatgggtcccattcctcctgactgggtaagacctcccaataggggtctccagacaccttctagaggagcatttgggccagcatcaggtcgggacccctgggatggagctcccagaggaaggagcaggctgtcatatttgctgttttgcagccttcactggtgatacctctaggtgcaggagggtccaaggcaactagggtctggagtggacctccagcaaaccacagtagccctacaaaaaggggcctattaaaagaaaaacaaacagaaagaaaaacaacaacagcacagaccccataaaaacccattaaaacgttagcaaacccaaagatcaaaagtagataagtccacaaagatgagaaagaatcaacacaaagatgttaaaaactcaaaaagccagagtgtttcttctccttcaaatgatggcagcatctgtccagccaggccacagaactgggctgagactgagatggatacattgccagaagcaggcttcagaaggtgggtaatagcaaacttcactgagccaaaggaccgtgttctaacccagtgcgaaacagagaagaatcatgataaaacattacaggagctgataaccagaataaccagtttagggaagaacagaaatgacctgatgcagctgaaaaccacaacacaagaacttcacaataatgcaatcacaagtatcaacagccaaacagaccaagcgggagaagaatctcagagcttgaaaactatctggctgaattaagataaacaaacaagaatagaggaaaaaaaaaaggaacaaacaaaacctccgagaaatgtgggattatgtaaaaagaccgaacctatgactaattggggtagctgaaagagatggggaaaatgaaaccaagttggaaaacatacttcaggatatcatccagaacttccccaacctagaaagacaggccaacattcaaattcaggaaatgcagagaaccccagtaagacattccatgagaagatcaaccctaagacacataatcatcagattctccaaggttgaaatgaaagacaaaatgttaagggcagccagagataaagaccaggtcacttacaaatggaagcccatcagactcatagcagacctcttagtggaaaccccacaagccagagatttgggggcaatattcaacattcttaaagaatttccaacccagaatttcataactggacaaactaagcttcataaccaaaggagaaagaagatccttttcagataagcaaacgctgagagaattcaacaccaccagggtgccttgcaagagttcctgaaggaagcactgaatatggaaagaaaaaccattatcagccactacaaaaatacactaaagtacacagaccagtgacactacgaagcagctatataaacaagtctgcaaaaataaccagctagcatcatgatgacaggatcaaattcacacataacagtattaaccttaaatgtaaacaggctaaatgccccaattaaaagacacagaatggcaagctggataaagaatcaagccctatcagtgtgccgtattcaagagatacatctcatatgcaaagacacacacacgctcaaaataaagggatgaaggaaattttaccaagcaaatggaaaacaggaaaaagcagggagagcaaatctggttccagcaaaacagagattaaaccaacaaaaaatcaaaaaagacaaagaaggccgggcacagtggcttatgtctgtaaccctagcactttgggaggccaaggctggtgggtaacttgaaatcaggagtgtgagatcatcctggccaacgtggcaaaagcccgtctgtaataaaaatacaaaaattagcagggcgtggcagtgcacacctgtaatcccagctacttgggaggctgaggcacaagaattgcttgaacccaggaggtaaagactgcagtgaggcaagatcgcaccactgaactccagcctgggtggcaaagactctgtctcaaaaaacaaacaaaccaacaaacaaacaaaaaacaaagaagggcattacatgatggtaaagggttcaattcaccaagaagagctaactatcctaaatacatatgcacccaatatatatatatgcatctaatacaagagcacccaaattcataaagccagttcttagagacctaccaagagacttagactcccacacaataacagtgggagactttaacaccccactgtcaatattagacagatcaatgagacagaaaattaacaaagctattcaggacctgcactcagctctgggtcaagtgtacctgatagatatctacagaactctccacccaaaaacagcagcatatacattcttctcattgccacgtggctcttgctccaaaatcatcacataattggaagtaaaacactcctcggcaaacacaaaataactgaaatcttaacaaacaatctctcagaccacagcacaatcaaattagaactcaagattaagaaactcacccacaaccacacaaatacatggaaattgaacaacctgctcttgaatggcccctgggtaaacaatgaaattaaggcagaaatcaagaagttctttgaagctaatgagaacaaagagacaacataccagaatctctgagatgcagctaaagcagtgctaagagggaaatttatggcactaaatgccctcaaaaagctagaaagatttcaaatacacaacctaacatcacaacgaaaagaactagagaaccaagagcaaacaaaccccaaagcaggcagaagacaagaaataaccaagatcagaagggaactgaaggagatagagacacacacacaaaaaaaacttcaaaaaaaatcaatgaatctgagttggttttttgaaaaaaataaaatagaccactagctagactaataaagaagaaaagagagacgaaccaaatagatacagtcagaaaggataagggggatatcaccactgatcccacagaaatacaaacaaccatcagagaatactataaatacctatatatacataaactagaaaatctaggagaaatggataaattcctggacacatataccctcccaagactgaaccagaaagaaattgaatccctgaatagaccaacagtgagttctaaaattgaggcagtaataaatagcctaccaaccaaaactagcccaggaccatacagatttatagctgaattctacgagaggtacaaagaggagctggtaccatttctactgaaactattccaaacaattgaaaaggagggactcctccctaactcattttatgaggccagcatcattctaataccaaaacctggcagaggtccaaaaaaaaaaaaaaaaaaaaaaaagaaaacttcaggctgggtgtagtggctcacacctgtaatcccagcactttgggaggctgaggcgggtggatcacctgaggtcaggagttcgagatcactctggccaacaagtgaaaccccatctctactaaaactacaaaaaattagctgggcatggaggtaggcacctgtaatcccagctactgggaaggctgaggcaggagaatcgcttgaacccaggaggcagaggttgcagtgagctgagattgtgccattgcactccagcctgggcaacgagagcaaaactctgtcacaaaaaaaaaaaaaaaaaaaagaaaaagaaagaaagaaagaagaaagaaaagaaaaaagaaaacgtcaggtcgctatccctgatgaacatcaatgcaaaaatcctcaataaaatactggcaaaccaaatccagcagcacatcaaaaagtttatccaccacagtcaagtaggcttcatctctgtgatgcaaggttggttcaacacacacaaatcagtaaatgtaattcatcacacaaacagaactaaaaacaaaaaccacatggttatctcaatagatgcagacaaggcctttgacaaaagtaaacatcgcttcatgttaaaaactctcaataactaagtattgaaggaacatacttcaaaataataagagccatatatgacaaacccacagccaatgtcatactaaatgggcaaaagctggaagcattctccttgaaaatcagcacaagacaggatgccctctctcaactactcctattcaacatagtattggaagttctggccagagcaatcagacaagagaaaaaaataaaaggtattcaagaaggaagagaggaagtcagatagtctttgtttgcagatggcatgatcctatatctagaaaaccccactgtctcagcctaaaagtttcttaagctgataagcaacttcagcaaattctcaggatacaaaatcaatgtgcaaaaatcacacgcactcctatacaccaacaacaggcatgcagagaaccaactcatgaatgaactcccattcacaattgctacaaacagaataaaatgcctggcaatacagttaacaagggaagtgaaggaactcttcaaggagaactacaaaccactgctcagggaaatcagaaactacataaacaaatggaaaaacattccatgctcatggataggaagaatcagtatcatgaaaatgaccatactgcccaaagtaatttacagattcagtgctattcccattaaactaccactgatattcttcacagaattagaaaactatgttaacattcatatggaactaaaaaagagcctgtatagccaagacaatcctaagcgaaaagaacaaagctggaggcatcacactacccaacttcaaactatactacaaggctacagtaatcaaaacagcatggtactagtaaaaaacagacacatagaccaatgaaacagaatagagaattcagaaataagaccgttcacctacaaccatctgatctttgataaacctgacaaaaattaactcaagatgtattaaagacttaaatgtaaaacctcaaacaataaaaaccctagaagagtatctaggcaataccattcaggacataggcacaggcaaagatttcatgacaaaaacaccaaaagcaattgcaacagaagcaaaaattgacaaataggacctaattaaactaaagagcttctgcacagcaaaagaaactatcatcagagtgaacagacaacttacagaaagggagaaaatttttgcaatctagccatctgacaaaggtctacaaggaatttaagagtctaaaaggtcttaaacaagtcttaaaagtctacaaggaacttaaacaaatttacaagaaaaaaccaaaaaacccctttaaaaagtgggcaaaggatatgaacagacacttctcaaaagaagacattcatgcagccaacaaacatatgaaaaaaagctcagcgtcagtgatcattagagaaatgcaaatcaaaacaacaatgagatactagttcatgtcagtcagaatggcaagtattaaaaagtcaagaaacaacagaggctggcaagcatgtgaagagaaaggaatacttttacactgttggtgggaacgtaaattagtttaaccattgtggaaaatactgtggcaactcctcagagatccagaagcagaaataccatttgacccagcaatcccaatactgggtatatgcccaaaggaatagaaatcattctgtcataaagatatatgcacatgtatgttcattgcagcactattcacaatagtaaggacatggaatcaacccaaatgcccattaacaatagaccagacaaggaaaatatggtacatatatgccatggaatactatctaaccataaaaaggaatgagatcatgtcctttgcagggccatgggtggagctggaagtcattatccctcagcaaactaacacaggaatagaaaaccaaacattgcatgttctcacttataagtgggaactgaataatgagaacacacggacacatggtgggggagaacaacacactttgggacctgttgaggggttagggggagggagagcatcaggaagaataactaatgaatgctgagcttaatacctaggtgatgggttgatctgtgcagcaaaccatgatggcacacgtttacccatgtaacaaacctgcacatactgcacacgtaccccagaacttaaaacaaatgttgatgaaaaaaaaatgacagaatggctgaattgattaaaaaaagacccaatgttctgttgcctaccagaaacacacttcgcctgtaaagacacatacagatagaaaataaagggatggataaagatattctatgcggatggaaaccaaaaagggacatgagtagctatacttacatcagacaaaacagatttcaagtcaaaaactacaaagagagataaagaagatcattatataatgattaaaggatcaatttggcaagagaatataacgactgtaaatattacatgcacccaacattggagcacacagatatatacagcaaatatcactagagctacagggagagagatagaccctaatacaataatacatggagacttcagtacctcacttttagcattggacagatcttcctgacagaaaatcaacaaagaaatatcagacttaatctgcactacagaccacatgaacctcaaagatatttgaagactatttcatccaatggctgcagaactcacattcttttcctcagcacgtggatcattcttaaagacagaccacatgttagatcgccaagccagtcttaaaacattccaaaaagctgaacaaatatcaagtatcttctttgaccacaataaactagaaatcaataacaagaggaattttggaaactacacaaacacatggaaattaaacaatatgctcctgaatgatcagtgggtaaatggagaaactaagaaggaaattgaaaaatttcttgaaacaaataaaaatggaaacacaacatactaaaacctatgggatacagtgaaagcagtactaagagggaaatttatagctataagtgcctatgtcaaaaaagaagaaaaacttcaaataaacgacataacaatgtatcttaaataaacaacataacaacgtatcttaaataacttggctttggtttgcttttgcaaaattagtagaaaaaaaagaaagattagagcagaaataaataaaactgaaataaagaaaatacaaaagatcagtgagacaaaaagctggttatttgaaaagataaacaaaatgacaaacctttagccagactaaagaaaaaagggagaagatccaaataaataaaatcagacatgaaaacagagacattacaaccaataccacagaaattcaaaggataattggtggctcctataagaaactatatgcaaataaattggaaaatctagaagacatgaataaattcctagccacataaaacctaccaagattgaactgtgaagaaatcccaaacctgaacagaccaataacaagtaatgacattgaagctgtaataaatagtctcccacaaagaaaagcccaggacccaatggctgaactgctcaattttaccaaacacttaaagaactaatatcaatcttactcaagctgattcaaaaaaggtgaaggagggaatacttccaaattcattctacaaagccaatattaccctcatactgaaaccaaagacacatcaaaaaaaagaaaactacaggccaatatcactgatgaatattgatgtaaaaatccttagcaaaatactagcaaaccaaattcaacaatacattaaaaagatcattcatcattaacaagtgagatttattcctgggatgcaaggatggttcaacacatgcaaatcgatcaatgtgatacatcatatcaacagaatgaagcacaaaaatcatatgattatttcaattgatgctgaaaaagcatctgataaaattcaacatcccttcaggataaaaaccctaaaaaatggctatagaagaaacataccttgacataataaaagccatatatgacagaccaatagctagtatcctaatgaatgaggaaaaactgaaagcctttcctctaagatctggaacatgacaatgatgcccaatttcaccactgttattcaacatagtactggaagtcctagctacagcaatcagacaagagaaagaaataaagggcatccaaattggaaaggaagaagtcaatttatccttgtttgcagatgacatgatcttatcatatttggaaaaacctaaagactccactgaaaaactattagaactgataaacaaattcagggaagtttcaggatacaaaaccaacatacaaaaattagtagcatttctatatgccaacagtgaacaatctgaaaaagaaatcaataaagaattccgtttacaatagccatacataaaattaaatacctagaaattaacttaaccaagtaagttaaagatctccacaatgaaatctataaaacaatgatgcaagaaattgaagaggaaacaaagaaatgtaaagatattccatattcatggattggaataatcaatattgttaaaatgtccatactactcaagacaatctgcagatttaacacaatccctattcaaaataccaatgacattcttcacagaaatagaagaaataatactaaaatttataaggaactacagaagacctagaattgccaaagctatcctaagcaaaaataacaaaactggaggaatcacattaacctgacttcaaattacactacagagctatagtaaccaaatagcacagcactggcataaaaacagacacatagagcagtagaaaagaatagaaaatatagaaataaacccatatatttgtagtgaactcattttgacaaaggtgccaagagcacatattggggaaaggacagtctcttcaataaacggtgctgggaaaactggatatctgtatgcagaagaatgaaactagacctctttctcttgccatttacaaaaatcaaatcaaatcaaaatggattaaacacttaaacctcagacctcaaactatgaacttccacaagaaaacattggggaaactctccaggacattggactggacaaagatttcttgaggaacactctaccagcataagcaaccaaagcaaaaatggacaaattggagggcatcaagttagaagcgtttgcacagaaaaagaaataatcaactaagtgaagagactatgggagaaaatatttgcaaacgatccatctgacgaaggaataataaccagaatatataagaagctcaaacaactctataggaacaaaatttaataatccaagtaaaaaatgggcaaaaagatctgaatagacttttctcaaaggaagacatacaaatggcaaacaggtaaatgaaaaggcactcaacattactgatcttcagagaaatgcaaatcaaaactataatgagctatcatttcaccccagttaaaaccacttttatccaaaagacagacaataataaatgctgacaaggatgtggagaaaagggtattctcatacagttggtagaaatataaattaatataactactatggaggatagtttgaagattcctcaagaaaccaaaagtaagctaccatatgatccaccagtcccactgctggatatatacagccccccaaaatgaaatcactatattgaagagatatatacactcccacatttattgcagcactaatcacaacagccaagctttggaagcaacctaagtgtccatcaacaggcaaatggataaagaaaatgtgttaaatacatatatacaatggaatattattcagccataaaaaagaatgagatcctgtcatttgcaacaacatagatggagctggaggtcattatgttaagtgaaataagttaggcacagaaacacaaactgccatgttctcacttatttgtgggagctaaaatttaaaacaattgaactgatatagatagagaataaaatgatggtttccagagacagagagggcagtcaggcagtggtagtgggtaagcagagatagctaacggatacagaaaaagaaagaataagacctagtatttgctagcacagcagtgtgattatagtaaaaaacaatttaattttatattttaaaataaccgaaagagtataattgaatcgtttgtaacacaaggagaaaagcttgaggtgatagacacccccatttaaccagatgtgattattgtgtattgcatgcctgtatcaagatatctcatgtaacccataactatatatacctactatgtgcccacaaatttaaaaataaaaaatttttttaaaggattgctactttgactagccacatgccagaaacaaatataaatcttatctggaagatgataacatttttctatgtctaaattatgtcagtaactttttatatacaatgtttaatactcaattaaaacataagcatagaaagagacaaaaataacatgaagaaaacttgaatgaaacacaatgtacgcttgctacagttacacagaggcctagataatgaaattaccaaatacagactttaaaatagatatgcttaatatagtcaaaaagaagaaagacaaaattgggaattttcacagaaactaggctatttaaaacacaaaaataatttctataaatgaaaaataaaatagctgaaattaagaactaaatggttaggcctaacagcagcttagactcagctgaagataacactaataaactagaagaaaattcagaagaaaatgtctagaatgaagttataaagtcaaaagaaagaaaaaatagaacagggtaagagacaagggggcacagaaagaaagtctaatatacatggaactggaatatttgaagaagcaagagaagggtcagaagcattatttgaataaatatttgctaagaattttccattacagatgagataaatgaaaccagcactattcaaggacccctacaaatgccaagtaaaataaatgaaattttaaattaaacatcataataaaactgctgaaaagaggagaaaacagattactatgtggggtaataaaacagattactatcaaaggagcaataagaccgggtgctggggttcatgcctgtaatcccagcactgtggaaggccaaggcgggtggatagcttgagttcaggagttcaataccagactgggcaacatgtgaaactctgtctctaccaaaaacaaacaaacaaacaaacaaaatattagcagggcgtgctggcacatgcctgtggtcccagctactggggaggctgaggcacaagaatcacttgagcctgggaggcagaggttgcagagagctgagactgcaccactgaactccagcttgggtgacacagtgagaccctgtctcacaaaaaaaaaggaaaaagaaaaaaaaagaggcaataaaagaacagcaattgactactcaacagaaactatgaaagtcaaaaaacaaaggttatgaggctagattaaaaaaaaaaattccatgctatgccgtttacaagagacatatctgaatgacaaaaatatcaaaagtttaaatttaaaagcctggaaaaagagaactttactagagattgacaaactgcttgtcaaagtggttgtataaattttactcccttgtataggagttcttgttactctacattctgttcaacatttgcactgtcagtttttttttaacttccagtttgatgaatgtatagtaatatcttattgtggtttagatttgcatttctctgattactaatgtagttgaacacatgctcatgtttttttgaccatttggatttcctcttttgcctgtttaaattttctgccatttgatatatttgcctttgttcatcaaagtgtagtttattaaacattctaaatactggtcttttgtaccttgatggcttgtatttacattttttaaaatgtatttttttcactgtcctatcttctatgagagaatcacatactggtcactgactcaaagtccaaacaacagctatgagagagcaccaaacatcccgggcttgtctccaagtttgtgttgtaattgaaacttaattagaccataccatattctgtcagctctgcatgatggggtgtgtgatatatacatatgcacataaatatatgaccagttaattccacgaacttggtggttctggcagaaacaatatggggatggaagactaatcacacacacacacacacacacacacacacacacacacacacacacacacaggaatagatatattctaatctagtagaacaaataatttatccttccagaatgaaaaccatccaacataattcacctcaacctgtttccagatggcagcttggttctactagggaatggtggacttttggaattggtctctgatgctggcaaactgggtattctgcagtgacagcaggtagatcatccttggtaagaggaatccaccttatcaaatccacaaatggtctccattcctgtctccatggttaccttatatatacgtttatggtgcttatatatgattatatattatatatattagatactagtctgtctgtatgtataacttatataagtatatggtatctaaatactttttatataagtacatgccagggaggctgccattcccaaaataaataatcttgtccacctgatgattgagagccacctttatatatcttttacaggataaacaaatgggacacagatatctgcgtattttgtccatttcaagaggtacacccacatacttgtaactctctgttgccaatcttttaatatttctttctggagatttttttttgagacaggttcctgctctgtcacccaggctagagtgcagtggcatgatcttggttgactgcaacctctgcctcctgggttgtagcgattctcctgcctcagcctcccaagtagctgggactacaggcacataccaccatgctcagctaatttttgtatttttagtagagaaggagtttttccatgttggccaggctggtctcaaacaatctttaatatttcttgtcaactatctgaacatatggtctaatcattagccactgccatgttagtatggatctgtacctcaggttattttttatccatatgaggcagaaaaccagatgtacatcttgacgttctgcccattgggaggatttacttttacggtttttcaggaacactcttgatggtatagtacaacattggccaacttctagctgaggacagcatatcataaaggacaatctgtaaatgagcccattatttttctttctctgtcaacttatcataaagaattttctatgaggccaaaagtgtaaattaaaggtgagacagccgtgcagcaagaactggtgtcaagagaacccgagccaccttctcatgcaacttactcacgccttcatgactgattcgaacctgacctctgtatgtaccatttccatttggtgatggattgattgttcatattccaaattttgggtcttgatgaatcagttaatacccacttcatgttagacagctctgttgcaaaccaggtgctatttctcaaaagaattatctacagaagagggagtgcctttgctccaaaattccagggatcttcctattgataaatgccactcagtaaatgggtcagagtagcatagtcaaatgggatctctaacactgaaaaatccaaagtccaccaagtgctatgtcactttctaattggtatattccaaaggtgcaataactcatctttcactctgaagggaataacctcaaattgtctacagtattgtaatttagaaacttcacttctgtggtgggattttggcatgtatggtcttagtagatcagtgaaggaatttgccatttactgttcaccaggccaatttagcagaatgtcatcaatgtagtgaaccaaagtaacgttctgtgggataacaaaatgattcagatctgggaagactagattttgggaacactgacatagtctgaaggcaaaattgtgaagatgtactgctggtcctaccatgtaaaagcaaagtgcttcttttcgtccttgcaaattgatatagaaaaaactaattgaagtcaaaaaaactctgatttccactttgcccatactaattataatgactgttcccaccttctctttggaggttaagttttgtccctctgaaatcttattattctcagtgaaactaaagagcccatttcagggctggcatctctcatcatcctccctgggttctgaagagcacagccaccacggagtttttcaaagatgaaatgctcctctcattgaagcttttttttttttttgagacagagtctcgctctatagcccaggctggagtgcagtggcgtgatctcagctcactgcaacctccgcctcccgggtcccagtttaagcaattctcttgcctcagtctcccgagtagctgggattacaggcatgcgccaccatgccaagctaatttttgtatttttagtagagacaaggtttcaccatgttggccaggctggtcttgaattcctgacctcatgatctgcctgccttggtctcccaaagtgctgggattacaggagtgagccattgcacccgcccactaaggcattttttagtgcattagtaaatggagtgtcctctggggtatatgattgagagctaccttggagttggggtggctgtggggatgtgatagccatgataaaacattccaacattttaatatctttaagtctttgtactgcttcctcttcaacacaccaggaagttctgacttctcaatctcatttaacgagacaagtttaggtctcagtttcagtcaagcaagcaagcaaattgttagagtcagtcttagccatcatgctacatcattaaacccaccatctttattgataaattcagtctgatccagaattatattacatcttcctggctctaataactttagacttatttcttacacatattccccaggatatataagctatctcttcctgaatatttaaaaatcaaggatcatatgaagaaagttggtgatggttaactttacaactggactctggtttatcatgctttttttttttttgagacagggtctggctctgtggccaaagatggagtgcagtggcatgatcttggctcactgcaacctctgcctcctgggctcaagtgatctcctgcctcagactcctgagtagctgggactacaggtgtgtgccaccacactcggctaatttttgtctattttgtagagacagagttttgccatactgcccaagctggtcttgaactcctgcactaaaatgatcctcccaccatgacctcccaaagtgctgggattacaggcataaggcaccatgcctggcctagagtagagttcttaatgtttttggaaatactattcaaaggaactcagggcaaaaaacaaaagcaaagtaaaaaaataaatgacaaactgagagactaaataccacagataagggaaatctccctaatatacaagaactaaagatcaagggaggaaaaaagaccaaaaaccctgagagaaaaatagacaaaagacatgtaaagattgttcacaaaaatatagacacaaggaaaagaaactgtcaacagagtaaacagacaacctacagaatgggagaaaatactggcaaactatgcatctgaaaaggtctactatccagcatcaagaaggaacttgaagttataagaaaaaagaacgccagtaaaaagtgggcagaggacatgagcagacacttttctaaagaagacatacatgtggccaacaatcatatgaaaaaaaactcaacatcactaatcattagagaaatgcaaatcaaaaccacagtgaaatacatctcatactagttagaatggctactactaaaaagtaaaaaaataacagaccctggagaagttgtagagaaaaagaaatacttaaacactgttggtgggaatataaattagttcgaccattgtggaagacagcatggtgattcctcaaagacttaaaaacagaaataccatttgacccagcaaatatacccagtatatacccaaaggaatataaattgttctaccataaagacacatgcacgcatatgttgactgcagcactattcacaatagcaaagacatggaatcaacctaactgcccatcagtggtagattggataaagaaaatgtggtgcatatacaacatggaatactatgcagccataaaaaagaatgggatcatatcctttgcaggaacatggatggagctgggggctactatccttagcaaactcacacaggaacagaaaaccaaataccatatgttctcacttataagtgggagctaaatgatgagaacacacagacacatagaggggaaaaacatacattgggacttatcagagggtggtgggaggagggagaggaacaggataaataactaatgggtactattaatacctgagtgatgacacaatctgtacagcaatcccccatgacacaaatgtacctatataacaaagctgcacatgtacccctgaacttaaaagttaaattttatacagaagatagaaagacagacagacagacacacaggcacacactcagcaaggtgtggtggttcacagctgtaatcctagcactctgggaggcggaggtaggaggatcttgaggccaggagttcaagaccagcctggtcaacagagggagaccctcccatctctatttaaaaaataaaaaagattaaaaagaaaaagacactcaacttcactaattagaaagtgcaaattaaaattacattgaggggccagacacagtggctgacacttgtaatcccagaactttgagagtccaaagtgggaggattgcttgaggcaaggagtttgagaccagcctgggcaacacagtagactgtttctaccaaaaaaaaaaaaaaaattgttgggcatggtcgcatgcacctgtagtcccagctactcaggaagctgaggtaagaggataatttgagcccaggagtttgaggctgcagtgagctatgatcacaccaccgcactccatcctgggtgacagagcgagaccccgtctccaaaaacaaacaaacaaaaaaccccactagtgggccaggcatggtggctcatgcctgtaatccaagcgctttgggaggctgaggcaggtggatcacttgaggtcattagtttgagaccagctcagccaacatggtaaaaccctgtctctactaaaaatacaaaaaaaaaaaagtagccaggtgtggtggcacatgcttgaaatcccagctacttgggaggctgaggtaccagaattgcttgagcccgggaggtggaggttgcagtgagctgagatcatggcactgcctgggtgacacagcaagagtctgtctcaaaaacaaaaccaaaaaactacattgagataccatttcttacctattagcttagcaaaaaattcagaagctggacaatccaatctgttggcaaggctgagaggaaacaggcatggtcatacaacccctcgagaggtgaatttgacaataccctataaaatgacatatgcgtttaccctttgactcaacaactctacttgtagaaaattatcctgcaagatgcatttccagcaatgtgaaaagacagaaggccaagattattcctcatggcattatttaagataacaaaatacatattatacctttgtattgacagatagatgccaatataaatcaataatgggaaaaccctaaaattgaattcaaatagaaacaaacttagatattaaattaaatatgtaatcatacagaaaataacaattcaagtaacttttaaacgtagtattctgattataaaagtttttgtctaaggaaaaaaaacactggaaaggaatctcaaatttcacttaggcttgtgtttgtcatggttgtaatgtaataatttcaaaactattttgtatgtataagggaagcacaaacatggaaggagaaagatgaggaaccaccccagatgttggattttaattggtggattcatgatcttaaaaaggcccaggttaggagcaaccaggttagggtttctaaatatcactcattaccaaaagaaatgagatcagtgagggggtctttgcagtggctgagaaatgaggtgctgaggcctgctcaggggctgggaaacaaggctgaaattcaaaaaagcactttgcgggatgaatagatagaattgcttccctcagtaaaggagaagagagaatcagtaagtgagtttctatgatgaagagtggaaggggccatgatggcattgaactaaatatgaaaggcagagaactggtttttaacatgttttgaatcaattttgaatatgttgactttgagccaatagctttcagatgcttacaaacctccagaagttaagggggtgtcccaatttgggggtagtgtttctggtccttctcctcaaccagtttgatctcttacttacttcagggacagagagggcgccaggggcttcctgaggcttctgccaacgattgcctgtcatagggattacacgatgctccacagacaacgcccagaatcttctccctgcaggatcccagtgggctactcttgagtgagcgaacatcaattcccaattggggcagaaaagcattttcaagacctaactcagggacgggcccccacgtgtggaatttctctttcatccctgcagcgaaggctgactcggggcctctgtggtttgtggctgtctggcttcatcaggctccggctgcccccctgcctgcccagcgctcctgcctggctacagcaagcatgtcctgagcatccattctgagcaggcttcccgggcagccttcctcccctgcactcttggcattcatgtggcatggctataaattatgtccagcatgttcattttcagtttaaatgtgttctcatcccaaaggagcaactaatggcatcaagttactgacgtgaaaaaagcctgccgctacaatgactatggattaatgaaatagcagtcatggaggctggggtggcaataaatcgccagccactggtgacacgaattttaaattttgttctccatcccttgcccccttctccaaaattattttgctgtaaagttgtttggtaaatgtttacctttgcttagatgtttgctttctattaaaagttgatgcaggcagggcccctagctcttagaaaactggaagcgggatgagagggatttaaaagcctatcatgctttctctaggaggcgtgaaggcaaatctcttaatccaggatcatcactgactgataaatttcattcagaaaatttggcaaacacaaggttctttcagtgaacgctgctcatctggcatgtaagttactattcctaccttctgttatgacttttttcctaatgaatttaaaatgaggaacccgtacaattcccaccagtgtttttgaaaggtagcaagtctatttctcatctgatgaagggccccagggtatccactgatgggccacagggagtctcagaatctctgatcctaaaagcaaactgttcatacgtacagttggccctctgtatctgcaggtcccgccatctgtggattcaactaatattgggttgaaaatattcagaaaaacactgcatttgtatggaacaggtacaaactttttccttgtcattattccttaaatgcagtatagcaactatttccatggcatttacattttagtaagtattacaagcaatctacagatgatttaaggtacgcgaggatgcgcatgggttataagcaaataccacgccattttatgtcgggaacttgagcacctgtggattttggtacccaggatgtcctggagccaatccctcatggataccaagggaaaactgtatggttttctagaaagaaggtctttagattcatcaaattcactaaatgttctgtaacatcaaaaacaaacaaacaaacaaacaaacaaacaaaaaaacaaaaacaaaaaacgtaaggctaactatggtggactgcagtgatggctccagtttcttcctccccaggtgtccacgcccttgcaatggtgctctgcagtccctcctaatgaggagcctgtacccatcccttgattctggggtggccttgagattggctgtggtccatgggatactaatatgatacaagcagagttgaaaaagtatttgtacactggggcttgcctccttacagtgcccagaactccacagccacgtgaacaaggctgggcgaactgatgagctacatggcccagtcacctccacttcccagcagacctaccaaccagcaaccacatagagtgagtgagcccactgagaccagcatgcctaggccaaaccagaaggactgtccagctcaaactgctgacttacaataaccttaaaaaaaaggttattttaagcaactaagttctggggtagtttgttatgcggtaaagctaactgacttgctaggttggggaagttctcctggataatatcctgaagagagatttccagcttggttccattctccctgtcactttcaggtacaccagtcaaacgtagatgtggtcttttcacatagtcccaaatttcttggaggctttgttcatttcttttcattcttttttctctaattttgtcttcttgctttatttcattaagtcgatcttcaatctctgatatcctttcttccacttgattgatttggctactgatacttgtatatgctccacaaagttctcgtgctgtgtttttcagctctatcaggtcatttatgttcttctctaaacttgttattctagttagcaattcattgaaccttttttcaaggttcttagcttccttgcattgggttagaacatgctcctttagcttggaggagtttgttattacccaccttctgaagcctacttctgtcaatttgtcaaactcattctccatccagttttgttcccttgctggcgaggagttgtgatcctttggaggagaagaggcattctgggttttggaattttcagccttttttttttgctggtttctccccatcttcatggatttatctacctttggtctctaatgttggtgaccttcagatggggtctctgagtggacgtcctttttgttgatgttgatgctattcctttctgtttgttagttttccttctaacagtcaggcccctctgctgcaagtctgctggagtttgctgaggtcctctccagacccggtttgcctgggtatcaccagcggaggctgcagaacagcaaagattgctgcctgttccttcttctggaaggtttgtcccagaagggcacccaccagatgccagccagagctctccggtatgaggtgtctgttggcccctactgggaggtgtctcctagtcaggatacacaggggtcagggacccacttgaggaggtagtctaacccttatcagagctcgaataggcaaaaactggaagcattccctttgaaaaccggcacaagacaaggatgccctctctcgccactcctattcaacatagtattggaagttctggccaggacaatcaggcaagagaaagaaataaagcgtattcaaataggaagagaggaagtcaaattgtctgtgcttgcagatgacatgattctatatttagaaaaccccaccatctcagcaccaaaatctccttaagctgataagcaacttcagcaaagtctcaggatacaaaatcaatgagcaaaaatcacaagcattcctatacacaaacagagagccgaatcatgagtgaactcccattcacaattgctacaaagacaacaaaatacctagaaatacaacttccaagggatgtgaaggacctcttcaaggagaactacaaaccactgctcaagaaaattagaagatacaaacaaatggaaaaacattccatgctcatgaataggaagaatcaatatcatgaaaatggccatactacccaaagtaatttatagattcagtactatccccatcaagctaccattgactttcttcaccgaattggaaaaaaactactttaaatttcatatggaatcaaaaaagagcctgcatagccaagacaatctaaggcaggaagaacaaagctggaggcatcatgctacctgacttgaaactatactacaaggctacagtaaccgaaacagcatggtactcgtaccaaaacagatacacagaccaatggaacagaacagaggcctcagaaataacaccacacatctataaccatctgatctttgacaaactggacaaaaacaagcaatggggaaaggattctctatttaataaatggtgttgggaaaactggctagccatatgcagaaaactgaaactggacccctcccttaaaccttatacaaaaattaactcaagttggattaaagacttaaacataagacctaaaaccataaaaaccctaaaagaaaatgtaggcaataccattcaggacataggcatgggaaaagacttcatggctaaaacaccaaaagcaatggcaacaaaagccaaaattgacaaataggatctaattaaactaaagagcttctgcacagcaaaagaaactatcatcagagtgaacaggcagcctacagaatgagagaaaaattttgcaacccatccatctgacatagggctaatatccagaatctataaagaacttaaatttacaagaaaaaaacaaccctatcaaaaagtgggtgaagtttatgaacagacacttcttaaaaaatgacatttacgcggccaacaaacatatgaaaaaatgttcattctcactggtcattagagaaatggaaatcaaaaccacaatgagataccatctcacactagttaaaatggcaatcattaaaaagtcaggaaacaacagatgttggagaggatgtggagaaataggaacacttttacactgttggtgggagtgtaaattagttcaaccattgtggaagccagtgtggtgattcctcaaggatctagaaccagaaataccatttgacccagtgatcccattactgggtatatacccaaaggattataaatcatgctaatataaagacacatgtacatgtatgtttaatgtggcactgttcacaatagcaaagacttggaaccaacccaaatgcccagaaataatagactggattaagaaaatgtggcacatacacaccatggaatactatgcagccataaaaaagaatgagttcatgtcctttgcagggacacggataaagctggaaaccatcattctcagcaaactaacacaggaacagaaaacccaacaccgcctgttctcattcataagtgggagttgaacaatgagaacacacggacacagggaggggaacatcacacagcggggtctgtcggggcagtgggggactaggggaaggatagcattaggagaaatacctaatgtagatgatgggttgatgggtgcaaaccaccatggcacgtgtatacctatgtaacaaacctgcacattctgcacatgtaccccagaacttaaagtataataataataataaacctcaaatgagagggaaaaaaaagctaactgatacaagtaccagaccagacagtgtccgtttggaagatggggatgtgtcttattcagtctttgtatctcctttccctttaaaccctgtaaccattcaatatgtatttgttgaactgggtagaaatggccccttgaaaaggctgcaattaaacccctttttctcaaggctactcaagtcaatcaggagggaaacagcacaccaaggattccatttcctcatttttataaaatgggcttcaaaatacctaccttgtcatgctgttgtggttgttaaagatcctgtgtgctttagagatgtccttgatacataatagacggtggctcaagcagaaacaagcttatggaaaggctttagaactcatcaggatgcaggatattgtatattttttttctatcaaagtggtcaccatgtgttcagcctaagaggactccagtttcaagtcatcagctttctctgttgtagaagtaaggttggttccttcacgctccatcagacatccatgtgccattctaacagtgcctcgtcagaggacttgcggcgccctctgtgaaagacggggagggctcctgagcgggactcaggaatgtgggttgctactctggattctgccaccgcccatttccttgcttgtgaaataaagtgtggatgactgcacgctctctaagaatcctttcaactctaggaatccacgggcttcagttaccaccagtgtcatctaagcgtgagggactgcactgctcacaggatccctgagccataagacaattgacatttttagaagtggaaaagaaaaggttttctgtatttgtctaaagtagaaaggcagaagaacaggccaaagaattaggaaataataaagaggaaaaagcaagcaagcaagtctgatttgagctgggatgcgagaaccttgcttgctgcaggataatggagctttacaccgtgcataccacactcacacactcacatgctgaaccacacatttggctaattacagaaaaaatttcaaggaaaaaaaaaagacatacacaaggagttataaaatgctgatgagaaaggtttacacaaagagctgtgagacattcgaaaaactggtttttggcattaagacttcctatccttttctagtaatatctaaaatggcttcttcctagcatttaggataaaacttcttgtgttggagaagtatttggaagtaaataacaaacacaaacatcatttatcacaaagagcaaaagatgacatctcaaaattctgcttcttgccaaaatggacattaagtttttgcttggaagcaaatgtgaaaatagtgacttttatctaattatccctacatatatccaaagagaaagttataacttatttgtcatgcttttaatatgattttctgtcttgaatgttggtattttaaacattaaaatcgccaatgagtaagcaaataagacaattaccagatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcggtggggcaagagcatgcgcagatggagtctggagggacggctggagtggagtgtgtgggacctgaaggtggtcgtaaggctccgcgtgcggctcgtgcccatggcgactgcgcagaagacaggcggggttttttttctccctctaacattgtattacgatcattttaacgcatacggaacagttgaaaacagtgcagtgaacacctatatacctccgcctaaatcagacaacctagcactttgccatttctgctcgtcactctctccccacctgtagctatgtatacacgtattgtcgttaaactatttcaaagttgcaggcatcatgacatcacaactagtactttgcactgtaacttttttttgttttaggacggagtcttgctctgtcgcccaggctggagtgcagtggcgagatctcggctcactgcaacctctgacctccgggttcaagcgattctcctgcctcagcctccatagtagctgggactacaggcatgtgcaatcctcccgcctgggcctcctgactagatgggactataggctcacgccaccatgcctggctaatgctttttactttcctccagagacagtctacctatgtcgcccaggctagtcgcaaactcctggcctcaagtgaacctgaacctcctgcctcgacctctcgaattgctggaattacaggtgtgagccaccacacccagcttaattttcttttttgtttttggggtttgttttgttttgttttgttttttgagacggagtctcattctcgcccaggctggaatgcagtggtacgatattggctcactgcaacctctgcctcccgggttcaagcgattctcctgcctcagcctcttgagtagctgggactacaggcgcctgccaccacgcccggctaatttttgtatttttagtagagacgaggtttcaccgtgttagccaggatggtctcgatctaaccttgtgatccgcccgcctcggcctctcaaagtgctgggattacaggcgtgagccaccgcgcccagcccacccggcctaaatttcttagtttggacaaacgtgccatggtaatgcaaaatgtcattattaagggcagctggatggaaggtgtaggagtacactatagtgcctttcaatttttctgtgtatctaaagtcatttcaaaagtaaacatttattttaaaacatgaaggtggttatgcttccatgagtgtaaagtacaaaaggcaggctcgtggtgctgtcagaagtcagaacactggtttcagggctgggggtgttgggaggggctgggcatggttggctttgtgatctgggggctggtgtgttccatctgtgaatatcttttaagctgtgcacttaccagggatgtaagtcatatcttaataaattttcataagtttgacaaaaaataaaatgaggatgggaagcttgtttgggttgtggggcctcgggtgcttatccagccatgagctgtgtcccagatgcttctagaagcctggagggagctgagaacattccaagtcgaggtggcagagccaaggccctgaggtgggagcgcaatgctgcacatccccagctgtgaatggggtgtcctggtcagaagcagtgctgtgtgcactgcagggccggcaaatccacgtccacattgtggcttggtgcagtgaaagccaatctcagccccctccacagtgtgattagcctgccagcaggtggccagctggtcctcctgggaaatggtgccaacccagagactgggtgcaagtgtctcatccacggaggggcgctcagcagtggtgtcagcctggtgagcctcggtaagggcacgtgcaggatgctgagcctcttccgttcccatgcccgtctcaaggccacttgctccgtgggcccatccagcaagcatggtggccaggaaagaagccggctccattcacagggcgtgctgttttgctcacctcaggaccaagagcatcctccatagtgattctctttggtgggagcactagaaacatgaaccacagataccttcagcgtctgagccgctgaggcgagggctgcaggacaccctgctgtcgggaaaccctgcactggcggctggaaggcatgtggtggtggcgcctgctgtggctgcagcagttgctgcgaggcttcgggatctcgccggcccctgcgaggtgaattgtgacagtgcagagctccgtggtaccagggccccctgcatggccatgctgactgcagctgggagcccaccacacctctggttccccgctcttcccagggctggggtctaggccaggcccctcttggcctgcgaattgtgccctgggagggggacactgttccacaggttgggaccaaggacccagggcatgctactggctggctgggctgcagggatgccatgctcacctttctctctcatggccttgacgggaccggcttcctcattgaacagcattttccaaggtgtctgggattgctggtggggtgccaccctggctccttctaggcatgcccgtcattggccaccaagggggccagatgcaggtgcccatgctgctgtgggggcatctcccaacttccctcttagtcctgatgggcctaggcagggcctgatatgggggtccccatgggcttccggggctaagcctgccccatggtcccagggctgtccaggacacattcagaagggacatgagctcagcagctctgtttgaaattattatggaaccaagggccccccacatccaagtccactgggagtcgggacatggagttccgctgcaggtacctccaggaaccccgaggtcctccttgagccaaggccaggctgggcacaccataagtcctgggtcccccagagaatggcctgctgccctgggctccccagaagccccctcacgcccctgggccttggccacatggaagccccaccaggacaggtgtgagaggacaaggaacccatggtggggaagcagaccaaatgggccgctggaaccaggctggtgggccagggggcacctgcccatcccccttgcagagggccttcctgccacgtgaagccagcacagccctggctgctgaggacccttgcctgggtttggctgaaagaaaaacagacgtgatcaggcagcacctccagtgggcccaaagagtcctttctgggccgggccccacctgcctgggtctccggagtcctcagggtctctcggtggcccctggggtctgacactgaggacacacctgcaggctgctgatcccagagggaggggtgtgtgtcacctggggtagggaagctgtcggggcacagcaggtggctcctgggactgccccccaggattcaggctggctgggggcttcctgccccatgccctcatcccagggctgttgggcctggtatatgatccccagtcagaactcaggtgggaggggccttggctgtcacccagcccccttgctacctcacttggggacctgtctctaccatgagtaagagggcccagatacggggccccctctgccctcctgggctgcccggtccatgccaggactgaccattcccacacctggctgaactcttggctctggctctgggccaggggtcccacctgtgcccttgccctgaaagctctgggggtcagggacaccgactcccttgtctccctggctcaaggctcgttgtcctggcacccttggagggatgttcaggagtgaggggcctctgctgctctctgaggctgtcagtgcttgcagggaggggtggggggggtcccacaaatgggtctggctcctccagtgccgtcaagggccctgttgggggggggcgggacaccgtggaaagtgggagggggcttgttggagaggtcttgcccacatccccctcctgcgtgcacagcatgtgcagtgcacatgcactgagcacctgccctgaggaccgggggcctattgtctttcttagagtccaggaggaaaaggaggaagaaaaggcacaagaggaaggcccaggtagtaggcttgggggtcccgggcgctcccccactattgactgccccagagggtgactcaggagggggcctggtatggaagcccatctgggggtggcaggtccccattcttccttgttagcttcctcgtagaggcccaagggtgcccgagagctgcgtcttcatccagggcctaggtatgggagaaccagcccccaaaactgcccatgggccagacctggatgtcttcatgaggccctctagggatagggtgggcatcaggccaggagagttccctgggagggtcagagcccatacctcattgccacctcaaccgtctcccactgggaggtgccagatccttttgtggccaccccaggggtccagatgtgcataggaggctgtggctgggggtggcctgggcagggaagtgctcaccacactccagactttcatctggaacatgtcgggggtgggcttggtgtcactgtgccctgcccagcccacccagccagacctccccctgggccagagcagaggatcatggggacagtgtgaggaagctgccctcaggccagtccgagtctgaccccagtgctccccagtgccattgggcacacgtggacttactccattaaaccttaaaggcagtgcatgccatcggcatcaacacctgttccccttctaccaaatacacatcccacaggtgcaggttgagcctgagagagatctatggggacagcagacactggaggacctggcccttcaaggctgggggctggtggctcgagctgggcccactgggacttcagtccccagagtcagtgaccctccccatgagggtcatctgacccttccaggaggctgggtcagacagggtcttgcagctcctcatgaggggcactcatttcagtgggatatggcttctggagagagggacctccccagggcttgaggcttctgagctctcccaagttgggttctgccccagtcttcccatgaggctgggcctgagccccaacctctgccgtgggatgacccttcttgggcacggggccttgcttgtgtgtcctacagggccccgtctgtgcctcctgtgggctgggggtgagccggacccctgggcacggggagcagggcactgcagggcaaagagggtccctgagccagggtctccctgggcctccttgccccatccatcaagctctggagcagccagcctaatgaggaaccctgcgcacatggcccttccttgtcgtgatgggaggaacagaagtgctcagggccccctgggctactctaaaaaccaaacctccctcttccagggtcctctgaagacccttccccaagtgcagaacacaggatggtgtccagggctccacacgacaccttccccttcccgcactcccagcggacacactgcccttagccttgctctgcaggaggtgggccccagtgcctgtgcctctgtctcctccagggcgggaaaggaaacccaactccaaacgcatggagaaccccacatcccaggtcaggccctggctgggactcagcctctcatcagtcccatgggggtctctagccagccctacgggatgcagggcctctgggaaagagccgaggggaccataaacacacagggtgcctcgtggtcttgggttatgacgtgggtaccacgtgttcctggtggtcttgtagcccctggacccttgtgctatttgggctgtagaatcctgagacgcccccagcccatcatgaaaccagagccagctcccaagatgtggagctgtcagctggaagaactgggcagctgcagaggcccccgaaccccgaggcctcccaccctcccatctgtgaccccaccatgtggccttggccctggggagaaggggtgggaacatcccctggagcctggctggaggtgctccgggaggcctcctgggccagggtgccgggagggcaggcctgactttgaggccacaacagagagtagaaagaacaaggtgggtgctgggacccctggttgtctcttggaagtggggtcaggccaggggacatgggatggggaggtgctgccatctgggctttgtcagcccacctgtgggaaccaagggcagctgaagcccagccagctggaggccaggaggactctcagggaggggagagtcagctgcatagaattcgagctggagagcgtggctccaggacatagagggcggccacggcgaggatgagatgccctctgctgatggggatgaaaggcatctgactcagggtctgggggtccccattcatccatggtctcctgtgggaccttcagcagagacatcctaaaggctcccaacaagctggtgacacaaggaaggtacctttgctgaaagtcgagatcatctggctagggtggctgtccccgggtctggctgcatgaggtcggggggcagctgttcacctaccctgtggggagtgcctctcacaagccaacagctgggccagtgcccagaatgcatcctccccaggcccataaaggagaaacaaggcagcagcgtggctcaggtccctgcggtagcccacctcctgcaagatccagagtcaccatggaaggacatctcctggagggctgaggtcacctgggaggactcatgtcatcggagagggcagaggtgactggggaggcttcctctgaagaagaggcttcctcaggatgcaaatttattttctgacaagagccatgtccatcaggcacttcagcaacttgtccaaaatgtttcctgagagcactgtcctgcatgtgacactaccaagctcctgggctttggggcagccccaggaggagggtgtcatttcttgttatgaaaagtggtggtcaggcccaggtgacactagtagttggggccctgacttctttgtctcagtttgaccccttgagaccacctcccttgcttggagatttatgccaacggtgagctggagtcctatctactatatcctgatgggtcacaaatactgactttgaaagaaacaacgatgcccctaccagacacccacgcccacgaacgtgggaatatggcccagaaacgtcactgcctgggaatactcatggggttatatgccaaatataccaggaagatgtagaataattcctgctgcctaggaaagagataaaaggggctttcgtttgttttgtgcagacgcttttagtttcactttgcctacaaaccctaacaacaaatccagtttcaggttcagatgattcaccagataagtcacaagctcttcaggaccttggttgtttaagaaatgtttcaggccaggcgcggtggctcacacctgtaatcccagcactttgggaggccaaggcaggtggatcacgaggtcaggagatcgagaccatggtgaaaccccgtctctactaaaaatacaaaaaattagccaggtgcagtggtgggcgcctgtagtcccagctacacaggaggctgaggcaggagaatggtgtgaacctgggaggtggagcttatagtgagccaagatcgtgccactgcactccagcctgggtgacagaggaagactccatctcaaaacaaaacaaaaaaaaaaagtttcagtaaaatccacatctgtgaaatgcagatatcccagttgtatagtgagttgactgatcacactctgatttttattttttcagtttgcacacccaccagttcagtctttggggtgtacagtacctccatggttctaaaccaatgtgcagagtctcctggtcaccactccagcccctcctggagcgattccttcatcctccaagtctccagggtgtcccctatgtagccaacctcttcccggtccatcagcccttggccatcccaacgtgttttctgtccctgtgatttggccttttccagaatggcctattaattggaaccctacagaggtagcttgttgggtctggtttctttcccttagcaaaatgcaactaagatccactgacgttcatgtgggcatcactggctcattcacttttctcactgagtcttttttcctttgaagggagggccacccatcctctccccattcccatgttgaaggttgtccccatggcctctgtgtgtgagtgacgatgaatcaagcagtgaatgtggcatgcatgtttcatgtgtgttaagtaaaatgtttatttagaaacagaatgcttgatccttagtaccacaaagaaacatcagcatttagacaaaaagttttctcagcaaggcaattttaccttctgcagaaagggtgctcctcacagatggaacaatggtgagagcacacctgaataaaagagggaagcaatttttatcctttatgcagcttgtccctgctactgtgtcctgtctccattggctggagctgggccatacaatctaaactaaatctgactggctaataatttaaaatgtctctaaatagctgaaagcaatggagaacaaaggaaaagaggaagctgcttatgaaaagacttagaaaagtaataacattcccaaataaggaaggggcacaggcttcaagctgggacctgcctgtgagcacgtccagcacagataaccctgattgaagtacgaggacatagaatgtacttattcctttatatctaacagctgtgtagaatagggcttaacaaagagttattagcacaaagcaaggaggcttgaaggaaattagtctttaaaggaaactgttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtgtgcaactgctctggaacacagaggcaggctggagggcgagcgggtgctcagcaccagtgacattctgaggtcatggcacacatcacagtggggccttgcctgggtcatcagagcccagagtcagcgtcctccactgcctgaggcgtcaacatgcctgcatgcaatgtgtgcacttgtgtgcacatgtgtatgtgggtaaacacatctgtgcacctgtgtgttgcttctctggccaggcctggctgccccactcatgtctgcacccagttcctcatcactgttacccccgaggcccaggaccagcatcagagcatccatgggtgctccctaacttcagccctccccaaccagggtggtcctgggatacacataggggtggagggaagttactgttgctgttgaatatcagaataaaaatgttaatactattacctaataacctttcagtatctgtaggaactcttaatggtatccctttttgtatttctgatattttaatgatatgtttctctccatgacccttggttattctaggtagagggtcctgtggggaaagtgcctggcaccctgtaggggctcactcttctagaaatgtgatctgaaatctggctcacctgtccttccacccagggcctaggggatgccgagttccggagaccagaaagagcttgggataaaaagaaggtttaaggggaaggctttgacctgggctgggtttgcctgcgccatccaaacctgcaggctcgagtcctgagacacagggggtccagatgtcccaatgcagggccctcctcattaacacctgctcccctgtactcattagtaacctcacccatcctaccctcaaagcacagttggccctggtatccgtgggctctgcatgtgtggattcagccaacagtgggtggaaaatattcagaaaagggagtgtggatggctatgtctctgctgaacatgtacagacttttttcctgtcaccattccctaaacaatacagtataacaacccaatgacagccctagcaagtagagacaatgaaaaagaccggctcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaacacacatgagaaaatgctcacaatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagacagtttggccattcctcagggatctagaactagaaatatcatttgacccagccatcccattactgggtatatacccaaaggattataaatcgtgctgctataaagacacatgcacacgtatgtttattgtggcactattcacaatagcaaagacttggaaccaacccaaatgtccaacaatgatagactggattaagaaaatatggcacatatataccatggaatactatacagccataaaaatgatgagttcttgtcctttgtagggacatggatgaagctggaaaccatcattctcagcaaactatcacaaggacaaaaaccaaacaccgcatgttctcactcataggtgggaattgaacaatgagaacacttggacacaggaaggggaacatcacacaccggggactgtggtggggtggggggcggggggagggatagcattaggagatatacctaatgtaaatgacgagttaatgggtgcagcacaccaacatggcacatgtatacatatgtaacaaacctgcacgttgtgcacatgtaccctaaaacttaaagtataataataaaaaaaagaagaaaaagaaaaagaaacagacctgctcacattgtccagctttgaagtcttggaagaagttgccaccaggatgcaggtaggggtcaatctcctccaggatccagagagcatatcagccagcttcagggtcaggaaaggagcctgacaggtctgcagtaggacggggctggggctggccgtgtggatcacgtgggcctaatgagggggaaagtaagaccatggggcaaaggagggagcatgggggcagctggtggcctaagcagaaggaacttcagagaaggggtctgcattagttcattttcacactgctataaagaaataccagagactaggttatttataaaggaaagcagctaaattgactcgcagttcaggaaacttccaatcatggcggaaggcgaaggggaagcaggcaccttcttcacaaggcggcaggagggagtgagtggagaatgaggaagctccacattttaaaaccatcagctctcctgagaactcactcactatcaggagaacagcatgggagaaactgcccccaaatccaatcccctcccaccaggttcctcccttgacacatgaggattacagctcaagatgagatttgggtggggacacagagtcaaacctatcagaggctcactctgtctcgtggctcccccagggctcaggctgagtgcagatctgatctgctggccctgctctacagcacgctggggctctgcctgtgcatccccatctgtggcttcccggcgtggcggcctgttccctcaaaaggagggtggctctgctctcctgccagccccctgcagggcacgatggagccctggccacgtcctcccagggtgagggcatgaaactgggctccttgcccttcttgctgcttgggtgacaagctttgggtcatccctaggtcctgtcactgttcctgcttctaaatggagagcattttgccacatcttcctgggagaggctgggggttcgtccttgttatttgttctatcttggtaaaaccaggttaagttatctgggcaagcagacaatagagtggcacccaggaagggtggggtgtagggtgctggcctttgggcttgcctggaccatggttggaggggggaaggttaccaggaagcaggactgtcagggctaaagtcaggaggaagtggttatgctgaggggggaggtgtgtggctggcttggggcaggacgtaagtaagagccaagctctgtcagctcacagagagggccgctggcacctagtctagaggctgtggagcccaggggttgcccttagttcctggatccagggagacttctggagcctgtgcctatggctttcaggcacagggtgaagctggtgagggcagggggaagggtgagagaggaggccttgcatggcagggcaggacaggaagctggccagagaccagtttgcagtggctgctcccatcctcacccccacccccaagcacacccctaccccagctgggcctgggcacgtgtcctctgctttggtctcagcagatcacaagatggaagctggcagcctagtgggtgtgccactcaagccagtggtgacctgtgacttctgcttcctggatcgtggggtgcccacccaggagagcacaggtatgccccacacccctgaccttgagggcgctgggaggtgggggaccaatgtgctctatccctgtgtgtatgccctgaaaggtggcctaggagtcctgtgtgcgcccatccacgtggggtcccaggagcttcaacggtggcagggagggagacgaggagggagaaagaagtggagaagaaggagagagaaagagagttggggagaagagagtgagacagaaagagaggaagagagatgggggaagaaacagagaaagagagatagggagagagacagaggaggctgagaggaagaggagagagagagatagggagagagacataaaaagcaaagagagagacagggagagaggtgcatgagtaggaggtcgggtcattcttgatcacagttccagggcaacctgtaggttgccattaactaaccacacatataataaaggcttctgcctgctgcttacagccctcaagaacctctactcctggagactaaaacctttgacggctgcccttcctcactggatgtttgtcgtgtcttctgacgaaccgtgatgcctctttgtaggaatggtatcaataaagagccagatttgaggaggagagtaacgtgaggcattccaaaccattttcagctgaaaggtctttaattaaggtttcaaactctttagtagttggattgctggcgtcatcagtgctggtgccctccttttctttctttgattcattgtttaaatctgttgaggattgaacaactgtgaagttgacctgaatagcaccttcactcctgacagtcacatcttggtaactggattatacctataataaaggaggcagatcagaaccacagtccttcagctggagtaccccagccctgggaaaacaggtgtgcagagaatgtgtgaatccttgggataaatgtggtgcatcttcctaaagagacattttcatgttgagcaatttattatttttgatacattaattaataaataaaactcaggggacaggcttgcctgggaggacttagcgagtctcacagtgtcctcagggtgccgggaatgttggctttgtttcaaacccatttcctttcacagagaacctagccatcacatggggctggatgaggtccaggggcaactgagggttcctggccaaggccacaccctagtgttacctgtaggcttctgaactaaccccagcctctgacagcccaatgggtgatggcaaccgggtctccaagcttcttctatcgcaattttcctcttctccttttcatgaccaccatatctcctatccactctctgtatgcaatgctgcaggaatttttacagttcagggaagtaatcctgttaggcgagatcaggaaatgccataagggattgctgttttcttgattttctagaaacagagggcctccccaactgcccccaaacccccaccccactgcagtgagcatctctctctttacccttggtctggagagcacatggtatttcaaggtcaaaatcgccacctagcggagtaggaatcctctccatgaggcacattgtcagccctttgcagaaacattccagcttcccaattctccctttttgaacccctctactagacaccaggctttctgccccttcagtaaatgggaaaactcaacgatgagaaggaaaatgtcctccaaaaccaaattttaatcttgatactgtcccatcagcaggaaaaccaccattcagtcctacgttctttcaaggcaccagaatattctgcctccaattaaaatggtacttaggctgggtgtagtggctcacgcctataatcgcagcactttgggaggccaaagcaggcagataacctgaggtcaggagttcaagaccagcctggccaacgttgtggaacaccatctctactaaaaatacaataaatttgccaggtgttgtggcgtgtgcctatactcaggaagctgagacaggaaatttttttttttttttgagacagagtctcgctgtgtcacccaggctggagtgtagtggtgcgatctcggctcactgcaacctccaactccctggttcaagcaattctcctgcctcagcctcccgagtagctgggattacaggcacgtgccaccacgtccagctatttttttttgtatttttagtagagacggggtttcaccatgttggccagaatggtctcgaactcctgacctcatgatctgcacccccctcagcctcccaaagtgctgggattacaggcatgagccaccatggccagcgaggcaggaaaatttcttgagcctgacaggcagaggttgcagtgagccaagattgcaccactgcactccagcctgggcaacagagtgagactccatctcaaaaaaaaaaaaaaaaaaattaataagtagattttatgcccggaagttaactggagccactacctaagaataaatactttagtatagaccataataacaaactgtagagctcaaaccagcacactccctccattaaggggccttgcccaaatgcaactgttacatagtcctccccaagatctatctattggggaaccacacaggtcacacaagtctaagaagtcaaagggaaatcaccagcagaggactagagtcacatggatgaatgtgactaatccctttgcttagttcctccgattccatggctgagggtcatatctgcattactgggcagcacctttaacagatgccagggctcagggaaccaaggaaggaaaaacagttggggggtcgaccccactgtcttcccctccatcctgagccattgaaggagggagaccaaagggatgcctttttcttgcttctctttctagatgggtaaagaccaacttcagcctgtacttctctggaatgcattctgaatcactgggactcctttgaccccaagactttgaaggaaaagcagctcattttcttttgcgcaagggcatggccttcttatcatcttgaaccagcctggcctgtggaggggagctttgattttaatactatccaacaattagatcttttctgcagacaggagggcaaatggtccgagatcccctatgtacaagctttctttgccctgcaagacaacccagacctttgcaagtgttgcacaattgactcaacttttttagcagtcatatcagacgggccaaaagggaatgactccccaaaactagagaagcaacttccaggggaacaatctgaggcagctattgagtgtccaggcccttgttgtcccccttctctggggccccctccaaccatgccattagctccttcagccctaccacctctgaaactccccacatccccctacaggaaatgcccaatggaggtgatgccactaaggttcaagttcccttctaattgcagaaccttaggaaaataagggaagacttaggtcaattttctgatgacccttatagatatatagaagctttccaaaatttaactcaggtgtttagcttctcatggaggaatgttatgctgctcctaaaccaaacacttactacggctgaaaaacaagcagctctgaaggcagcagagaaattcggagatgagcaatatgtctcctatagtaggccaaaaagggaaagagaaaatagggaaagtgaagaaaggaagaacggagaaccatcattcccaataggaagaaaggcagtaactcctgacaaacctgattggaaccccagtgataccacagatgaatggaaaaggaaaactttttaatgtgcatattggagggcctacaaagaactagggccaaacaccttaattactctaaattgtccatgataggccaaaagccagatgagaatcctgcagcctttatggaaaggctgagagaggcactaataaaacacacctccttaacccctgattcagtcgagggacagctcatcctaaaggagaagtttattacacaagcagctcctgatattagaaggaaactgcagaagcaggctataggaccagatagtaccttggagaacctgttgagggtagccagcttagttttttataatagggatcaggaggaggcccaagagaaaggaaggaagcacaagagaaggacagagactctagtagctgctttgcaggcttgcaaagtccaggatccccgaggtgcatatgctagttgctactaatgtgacaagtcggggcactttaagaaggagcgcccaggcagcaagaaaaaaccattttgatcctgtccagcctgaggcagggaccactggagaacggactgcccccagagacagaggtcaccaggttcagaaccagtttcatagatggtccaacaggactgatgggtcttggggttcaaacccccagatccagtagcttaaactaccattacagcacaggagccctgagtgattctggaaattgaaggaaggaaggaaggtggacctccttctggacactggagccagattctctcttctcttctctgatctaggcttcccctcttcccatagcataactgtaagcatctcaggaaaggttctgacctgatatttttctcaacctcttagttgtagttggggggatctattatttatgcacaccttcttaatcatagctgaaagtcccacctctttactaggtagagacatttcagctcgcatggggatcaacatcctcatagccccaggacaaacacttttctccccctggtggaaggtaatatgaatccaggattgtgggcaactcaaggaagaatagattgagctgtaactgctaagccagttcagttccaccttaaggatcccacttcttttcctaaccagagacaatatctcctaaagccagaggctagcaaagggctagaagcccttattaataacctgaagatgaggggcttcctcaagccctctaacagcccttgcaataccccaatattaggagtgcaaaaacccaatggggaatggagactggttctagacctctgcctcattaatgaggccatagtcccaattcatccagtggtccctaatccctatatcttgctgactcaaatacctgaaggaactaaatggttctcagtcctagatttaaaggatgcctttttctgtataccattacatcctgactcacaatacctatttaccttcaaagatccctccagccaaactgcccagttaacatggatggtggtgcctcagggatttcgagacagtcctcacttgtttggacaggcattgtcaaaggacctttctgagttttcccatcctcaggttaggatcttgcaatatgtagataacatattgctctgtaccccaattgaggaagcttctcaggaaggcactgaagctcttctgaatttcttagccaagagagggcataaggtttcaaactccaaggcccagctttgccaaacctcagtgaagtacctgggtttagtgtgtctgaagggaccagagcattaggggaagaaaggattaatcccatttcctccttccccctcccccaaccctcaggcaactaagaggatttcagggcattagaggattttgcagaccatggatacctgggtacactgagatagctcgccctttatatcacctcataaaagaaacttaagtggctaaagctcatctcctgacctgggaacctgaagctcaaaaggcatttagccagctaaatcaagccttacgtaaggcacctgccctcagccttcccacagggagggccttcaatctttatgtatcagaaaggagggaatggccctgggagttttaatgcaagcctaaggaccagctcaatagccagtggactacctgagtaaggaacttgattttgtggctaaaggatggccagtatgcctctgagcagttgctgctgtggccctactggtatcagatgccaccaaatcaaccctggcaaattacttaactatttatacccccacataatgtagcagaattgctgtcttctaggggaagcctttagctaacagacagctggctctttaaatatcaagctctgctgttagaagggtctacaatccaattgaaaacttgtcctcacctaaacccaaccactttcctccccgaggaaactggggaacctgaacatgactgtgagcaagttgtggtacagacctatgcagccagggaggatctcagggacactcccctacaaaatccaggctggacccttttcatagatggaagttcctttgtagagcaaggagtctgtaaggcaggatatgcagtcatcactctgaatggtgtttttaaagtgcatccctctctccaggcacaagcactcaactagctgaactaatagctcttataagagcacttgaattaaggaagggaacagtagctaatatttacactgcctccaagaatgcttccttagttctctatgcttatgctgccatttggaaggaaaaacactttcttactgctaatggatctcctataaaatatcatcaggaaattaacaggttattatcatcggttttccttccacaaggggtagcagcgatgcattgtaagggacatcagaagggaacagatgaagtagctgaaggaaacatgttagctcatcagacagccaagtcagtggcaaggaagcctcagggcacaacacacttgaagccgcttgaatttgggaaggctccgtaagagaaatgaagcctcagtactcccctgcagagatagaatgggccacctctcgaaggtacactttccagccctcaggaccgttgaagtcagaggatggaaaactccccttgccagccttcagccattggaaagcccttaaaatccttcaccaagcttttcacttgggaaaggatataactgatctgtgtgcccagagatcgttttcaggagagaacttattaaaaacagtcaaataggttgttaatgcttgtgaagtctgtcttaaaaacaatcccctcaacaggcagctccttcctcctcaaacccaaaggatgggaagctatcaaggggaagactggcagatagacttcacccatataccaaagatgaagggcatccaatacctcctagtatgggtagatactttcactaactgggtagaggcatttccatgccgtacagaaaaggcctctgaagtaataaaagggtgagttaacgaaataactcctcactctggtgtgcctaagtacctcaaaagtgacaatggcccctcatttaaggcagccatcacacaggcgttctcaaaggcactaggcatatggtatcatctccattgtgcttggagaccccagtcctcaggaaaggtagagatgaccaacgatgttatcaagacacatcagaaaactgtctcaagaaactcaccttccttgggtcactcttctttccatggctttactgcgggtaggaaataccccttcaaagttaggtctgagcccttttgaaatgctgtatggatggcctttccttaccagtgatttcttattagaccaggagacctctgaattggttaaggatgtaacttctctagctcattttcttttttttttttttgagacagagtctcactctgtcacccaggctggagtgcagtggcgcgacctcggctcactgcaagctctgcctcccggcttcacgtcattctcctgcctcagcctcctgagtagctgagactacaggcgcccgccaccatgcctggctaatttttttttgtatttttagtacagacggggtttcactgcgttagccaggatggtctcgatctcctgacctcgagatccgcccgcctcggcctcccaaagtgctgggattataggcgtgagccaccacgcccggcctctagctcactttcaacagcaatgaacacaactggcaaaagcccagccctcaaaaacaggagcacctctatttaacccagaggatttcgtcttggtgaaagctctcccttctctccctcctcccccacgcccaagctgggaagggccctattctgttcttcttatatttatttttatttttatttttttttgagacagagtttctctttggttgcccaggctggagtgcagtggcgtgatattggctcatcgcaacctccacctcccgggttcaagcgattctcctgactcagtctctggagtagctgggattacaggcatgtaccaccatgcctggctaattttgtatttttagtagagacagggtttctccatgttgatcaggctggtctcaaactcctgacctcaggtgatccacgtgcctcagcctcccaaagtgctgcgattacaagcgtaagccaccgcgcccagcctctacactgttcttcttttaaccccctcagcagtacaagttataggtattgactcctggatacatcacactcaagtcaaagcatgtaaagctaagaggcaacccctgacagcccagaggaacgtcctggatataaatgtgaagaaatagaagatgttaagctgaaaatcataacagataagtaaatgagtgagggcttctctacctactcagtcacacccctaccttaccatataccttcagtcatttctacttttcctctcgagatttgccatcaaatattaaaacatctttttgaaatgtactttcagagagattttgattatccaggggattacatttgtaacttcacagacccccagagggaaagtctatatcttggtgagtaaaattttagatggaaattatctactatacctcccttgcaggaattgttgtgctcactctacttgtagtaggactgtatactgtcacacccccagaatggaatattggatgaagaatctcaatcactgaagtattttgcttaattattatccttacagcagggacaatagttactgacgacaggtaaacatgaaggttttactatcactgagtcagctaggactttttctttttcttttttactttttttttctgagatggagtctcgctgtgtcgccaggctggagtgcagtggcacacaatcttggctcactgcaacctccgcctcccgggttcaagcaagtctcctgcctcagcctcccaagtagctgggactacaggcatgccccaccacgcctggctaatttttgtgtttttagtagagatgaggtttcaccatgttggccaggatggtctagatctcttgacctcgtgatctggccgcctcgctctcccagagtgctgggattacaggcgtgagccaccgtgcccggcctacctgtgcacttttaaatgaaacatgctgcttctggatcagcatctctagtcaagtagaagagaacctacaggtgcttaaagaccaaattagaatcattgacaagttaagagaaaacgtggattccagtcttctttatggaattgattagttccttttttaagcccgctcttgctcgtgtgttttgtactaatatttggaccttgtatacgcaatacggtaacttgaattatttcctctcacctagaagctattaaactccaaatggcgccgcggatggaacctcgcatggacatgccattcttccaaggacccttagatcgactccaggaggagctctagctgctgtgccccactcaatgcccctctcttcagcaggaagtagccagaaagtcattgcccaataccccctaacaggagttagggttaccactcctgagaggggaaatatgatacaggagctagaaagaaattatttggcagacagtgagggtgaataagtcctcagcaaggtttcccttttaagaaaacgcagcccccaaatcatttcttttctaacaaagagcagcctgaaaaattgagctgcaaacataggtaagcaagttggaagcttgcacggggggatgccggcacctgtgctgatagaagaaagctaccgggggccaggcatgttcaacatggaggctccatcttcccttttgtcaccatgtgtacagtaaaaaaagcaggcaacatggcaccggccaggtagagaatccatctgaataataaaagattagggtggggcggccagcttctttgtgcactatgcaaacagcacacctagtcctaaccagttctttgaatgctatgtaaacggcacaccttgtccaaccaatctttcattccctatgtaaattagacaccacctcctcaagcacatctataaaacctcctgcacttcactgcagaccagaagacctgcttgggacctcctctctcttcaggagagagcttttctctttctttcacctattaaacctccatttttaacctctctccttgtgtgtctgtccttgatttccttggcatgggacaaggaaccttgggttttaccccagatgaacgatgccacttcaccactatgttgcccaggctggtctccaactcctgggctcaagcaatgttcccgccttggcttcctgaattgttgggattacaggcgtaaaccgctgttcccagtctgaaaaattttcttcagagagaacaggctttgtcagtggtctacttgaacagtatactaaattcatcaggtttggggatccaaaggaactgtccattatcctcatccatcagcaaaaagaataggccctttggtaaattatttttgtaagtgcttaatcctcaattacttgttgctgggccttgtcatcaccaggaatcattccgtgctttgtgtccttaatgccagcattcacgatttaaaactaagctttctagcacttgcttcactgtttcaaccactttcttcctgggactttcaaattctttgactcctgtgttagttcaagtctacagaaaagtagatgtcaaggactacatgtgaaagaggtttattagagaaggaacagaaggcaggacaaatcttcagactgattgcaggtctgactatggaaggagagagggaaggaaggagggttgggtaggactggactgtagcaaaattcagccaggccacagggagtctttgagccaaaattgcctgttggaggtctgtatgtcaacagaatgggcattcccttaacgcacctcttttattaatctaatcatccgcagtccccattactctagtcctactgttgaaaatcatacaatagtagagaatactgaagccactgttaaaggccctccatagtatcccttcttaattccgattgtccacagcagttaccacgactcctcgtccttctcagctcctcttctattctgtctcaagtaacactgcttgtgttttctgagagaatatggcacctgtaggtcattaatttatctaaaaagaacacgtgtagtcaatttctttcatctaagctaagagcaaaatgtgctttaccagtcttaggaccccatcccttttcctacaaccatgttgatccctctgagctgtatttaaaaatactcctcagctgacttcattcttacactctagttccttttttttttttttttgagacagtctcactctgttacccaggctggagtgcagtggcacgatcactgctcactgcaacttccgcctcctggcatcaagcgaccctcctgcctcaaccttccaagtagctgggattacaggcatgcaccaccatgcctgggtaattttttgtatttttagtaaagatggggtttcgccgtgttggacaggctggtctcgaacttctgacctcaggtgatctgcccgcctcggcctcccaaagtgctggggttacaggcgcgcgccaccatgcctggcccaccctaggaactttttttttgtttgatgggtcttgctttgttacccaggctgcaatgcagggggttcttcacaggtacaataaataatagctccctgcagcctcgaactcttgggctgaagtgatcctctcacctcagcctccgaagttgctgggactacaggaacctgccaccatgcccagctgttttataaaatatttttagaaatgggggtttcaccatgttgcccccaggctagacccatgggctcagttgtcctccctcctccacctcctgagtagctgggactacaggtgcacaccaccattcctggcaagaaaacattcttttttttttttttttttttccgagactgagtcttgctctgtcacccaggctggagtgcagtggtatgatctcggctcactgcaacctctgcctcccaggtccaagcgattctcctgcctcagcctccagagtaactgggattacaggtgcccaccaccacaccaggctaatttttgtacttttagtagagatggggtttcaccgtgttggccaggctggtctcgaactcctgacttcgtgatccgcccgccttggcctcccaaagtgctgggattacaggcgtgagccgctgtgcctggccaagaaaatattcttaattccatttaggttcacataaattccatttaggttcatatccaacttcagatgaattttcttgatagaacaaatgtgcagacttttcagtaatacagactgaattattcaccaaaactatattgacgctacatgacagaactaaaaaggagtaaattagggtcagtttaatgtttcattaggtatttagagaccaaaagaaaccacaaaatcttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactagagcctgcgcatgcgaacagcggagccttcctgcttttctccctcacttccgcttccgcctcggctcagccgcccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattc

SEQ ID NO: 1995 - DNA, 8565 bp, Homo sapiens
ttcttaccaggattctgcaggagaactgtgaaataccatgatggttttctctatcagtagggagcttgctgtcctctctgcatctgaccttctttctctaggagttcttagtttctgtagctttcactattctcctccttctcctcctccttctcctccttgtcctcctccttgtcatcctccttctcctcctcctcgtcatcctccttctcctcctcctcttcatcctcctcctccttctcctcctcttcctactcatcctcctcctcttcctccttctcctcatcctctttctcttcctcctcctcatcctcctcctgctcctgctcctccgccttctcctcatcctacttctcctcttcatcctcctcctgctcctgctcctccgccttctcctcatcctacttctcctcttcatcctccttctcctcttcctcctcttcatcctcctcctcctgctcctgcttctccgccttctcctcatcctccttctcctgctcctcctcctcctgctcctctgccttctcttcatcctccttctccttctcctttcttcttctttgagacaggatcttgatctgtcactcaggctggagagcagtggcgcgatcatggcttactgcaccctcaacctcccaggctaagccatcctcccacctcagcctctcaagtagctacagatgcatgctatgctcggctaatttttatatgttttgtagagatggggtttcgccatgttgcccaggctggtctcaaattcgaaggcttaagtgatcttcccacctcggcttcccaaagtgctgggattacaggcatacaccactgcgcttggcctcacttatttccttccttcctccttccttccttctttccttccttcctttcctttccttttctttccttccttcctttctttccttccctttctttctctctctctttctctctctgtccctccctcccttccttccttcttttcttccttccttcctccctctcttttctttctttctctatctccttccctccctccctctctccctccccccaacccttccttcctcccttctgagacaaggtctcactctgttgcctccgctgaagtatagtagcttgatcttggctcactgcagcctcaacctcccagtgtcaagtgattctcctgcctcagcctcctgagtagctgggactgcaggtataaacacacctggctaatttttttttttttttctgtagagatggggtttcaccatgttgcccaggctggtgttgaactcctgggctcaagcaatctgctcaccttggcctcccaaagtgctgggatttcaggcttgagctaccacgcccagcctcacttttttttctttttttttaaatggcagctttattgagctgtaatccacatatcataccgttcacttacttaaggtatacaattcagtgcttcttggtgtactcacagaattgtgaaatcatttccacaattcattttcaaatattgtcatcactccaacaagaaactctgtacatgcttagcactgcttttcgttttcccagccctaggccaccattcatgtacctgctgtctctgggtttgcctgttttgcacacttcacataagtggagccatgcactctatggtcttttcttcttcttcttctttatttttttattttttgagacggagttttgctctcgttgcccaggctggagtcaatggcgcgacctcagttcaccacaacctccgcctcccgggttcaagcgattctcctgcatcagcctgtcaagtagctgggattacaggcatgcgccaccacgccaggctaattttgtatttttagtagagacggggtttctccatgttggtcaggctggtctcgaactcccgacctcagctgatctgcctgcctcggcctccccaaatgctgggattacaagcgtgagctagcgcgcccagcccgtttctactttaatttttttttttttttttttagacagggtctcgctctattgcccaagctggagtgcagtggcatgttcatggctgactgcagcctgggcctcctgtactcaagtgatcctcccatttcagcctccccagtagctgggactacaggtgcttgcccctactactggctaaatttttatttttatttattttattattattattattattatttttgagacagagtctcactctgtcgcctaggctgcagtgcattgcaacctctgcctcccaggttcaagcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctggcacctggagatctggcttcagggacggcaggattcaggagaaaaccccactgtccgccactcagcctctgctgctatttattgctaggcctgaagtttaacagatatttatgggagcgccccgacctgggtgccaacctcacctcctcccttctcttcctccacatagctcgttggtcccaggccccttgccctcctgcccccgactttttctttctttcctttttttttctttctttctttctctttctttctttttctttctttctttctttctttctttctttctttctttctttctttctttctttctctctctttcttttctttctttctcttttcttttcctttcttttctttttctttttctcttttctttctctctctctccctctgtcctctgcccctctgcctccctccctccttccttccttccttccttccttccttccttccttccttctatgcttccttccatccctccaagctaagggtttaacccttgccctgcctgcattatggagtatcctgcattaggatactcctccttttgaggagagcaaacagaaaagtttgtggatacaacctggtgactggttttttgtttgtttgtttgtttttgttttctttcttttcttttttttttttgagccagagttccgctgtgtcgcccagactggagtgcagtggtacgatcttggctcactgcaacctccacctcctgggttcaagcgattctcttgcctcagcctcgtgagtagctgggattacaggcatgcaccactacacctagctaaattttttttgtattttttttgtagagatggggctttgccatattgaccaggctggtcttgaactcttggcctcaagtgatccactggccttagcctctgaaagtgctgagattacagatgtgggtcaccgtgcctggccaacaacctggtgactgtttacaagggacctgacacatcctgaatggttgacagtgatgacagtgatgatccctactcaagcttttcccagtagacacgctgagaggcaggcttcctctaagctatgttagcagtgttacaaagtgattcaacataaataatttattcaagcagggagcaagatatgagagttttgcagaacactaatacttctgtttgtaatttgttgtattttgtataaagtgacttttgagatgaaagggctaaggccatatgctaccatgctctaggattgccagtgatattttggacagtttatcaagcctaccactttccaggtgaaaaatggaaagatctcagcttaaaagggagaaacgggcctggcgtggtggctcatgcctgtaatcccagcactttgggaggccgaggcgggtggatcacctgagatcaggagtttgagaccagcctgcccaacatggtgaaaccccatctctactaaaaatacaaaaaattagccgggcatggtggcaggcgcctgtaatcccagctactcgggaggctgaggcaggataattgcctgaacctgggaggcggaggttgcagtgagccaagatcatgccactgcactctagcctgggtgaaaagagcaaaactctgtcaaaaaaaaaaaaaaaaaaaaaagggagaaatgtctaatcatctccggaattgaatggatgaatcatcctttgtttcgccagttccctctagatggacatttaggttctctctttctttctttttttgttttaaatagagacagggtctcactctgttgcccaggctggtctcaaactccagggctcaagcaatcctcccaccttggcctctcaaagtgctgggattacaggcgtgagctactatgctcagccttctgtttttttattattccaaaataataaaagtttacatcccagatgtaaagtttatgggtcaaagggtacatttatttttgacatggatagatttccttctaagtagcttcactcatttccacacctgccatcagggtaagagagtgcccccttgaggccatgctcgacaatgcctgatactttcactctaaaatgtagctctcaatttaactgaaaaaaaatttgccaatttaatgggtaaacatgacctctccttgttataatttatgcactcttgactaccagataggttggacatcttttcctaagcttaatggccatatgtccttgtgcccccttgttttttttttggtttttgtttttgtttttgtttttgagacggagtctcgctctgtagcccaggctggagtgcagtggcgcgatctcggctcactgcaacctccgcctcccgggttcacgccattctcctgcctcagcctactgagtagctgggactacaggtgcctgcctccacgcccggctaattttttgtattttgtagtagagacggggtttcaccgtgttagccaagatgttctcgatctcctgaccccgtgatccgcccgcctcggcctcccaaagtgctaggattacaggcgtgagccactgcgaccggccaccctcccgtttttttaattggggttcattgatttgtatatgtataaatgtatatactccttatactctggatcctaatcctcggtagttttgttggtcttaatatcttcatatcttctcgaagtctgtggcttgtcttttcactttcacttttgtatgtttcttttcttttcttttttttgagcctgcctcggcctcccaaagtgctgggattacaggcgtgagccaccgcgtctgtccatacactaggtttttaatccatccaaagtttaagtacatgaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaaatatctgtctctctgagtctctgtctccctctttctctggatctctgagtgataccctatattccccatcatcatctctctgggtctctgcctaccccaccccctctgtctttctgtctgtctttcttttttctttttttttttctttttttttgagatggatgttagaaatgtttattttgtggtgtcgtaaagaaatagtacttgaacataaatttaatttttttagtaaagccatttttattttttgtagaaagggtacactcgccagcagttttgtcatgagagtacacggaacaaaggagatagggtcatttataacctgacgcgtctattttactgctgtgtctggtttttattggctggaaccggactttacattttgtatttgtcttgattggctagtaacttagaagtttttaaaagaagcgaaggcagaggagaacaaaggaaggaggaagtaacttgtggaatgttgagaaaggtaaaaacacttttaaataaggaagaggaacaggctatgatctaatgcttgcttgaaccagtataagtatgtcagggcaaatatttaggctaaattgtgagagctaagaacataaagtacattgatttattttttatggctagtagatatttaagaatgttagcacaggtgtttgaataaattttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctcccca

SEQ ID NO: 1996 - DNA, 15186 bp, Homo sapiens
gacacaccagattttatgtgtttgatcactactttttgaaggaccattattaaggtgtctttcagaaagtagcatctgaatgtcttgaagacttaatcattaataccaagatagatatttttagcagtaaataagagttttattatttttgattagcttaagggagtccttctgtagttaaataaggcacagctaggggtttttttttgtattgtacaccttactactggttttcagacttccaagtgaatttacttaggcttaacttacatatatttagctaatatctgtaataaatatgttcctggcagatagtactatataagtatttactattactattttatgagaaaacagggtcaaagagtagtttaaatgttgggatatttaaatttttaaaatccttcatgtggaaaatacatacattttatcctgaatttaaatgcaaaatcagtttagaaactggtcaacacgtgtcaattttttttttaacacctagcatttatttagtgccattcattcattttcatggtttttttttttgctttttttttttttttccttgagatggggtcttgctctgtcaccccggctggagtgcagtggtatgatcatagctcactgtaacctcaacttcctgggttcaagtgatcctcccacctcaggctcctgagtagcgaaaattgtaggcgtgcaccatcatgcccagcaaataaaaaaaaaaatttttttttttttttgtagagatggggtcttgccgtgttgcctaggctgatcttgaacttctgacctcaagcagtccttccacctcagccttccaaagtgctgggattacaggtgtgagccactgtgcccaacctgttattttgctttttgttttgaagtgtttctttgcatattttgcctattctcttctcttgataaacctgcaaaaaaggcaagactagtatgattattctcttattatatttaagaaggaaactaaaacataatatgatggccagcatgatccaagtaaacttttttttgggggaaataaaactgtttctttagcgtgaaggcagaatataaattggtagaagctagtaaatggtacttgattcaaaatgagaattttagtgatttatatatgccatgtcattttgtaaaaatggtttaatgatttaatccttttttttttttttttccaactagatggagttaccatgtggattgacaaaccttggtaacacttgttacatgaatgccacagttcagtgtattcgttctgtgcctgaactcaaagatgcccttaaaaggtaagactgcagtcttttttgggtaagggatgttcacatttggatgagtagtattgttttgttttgctttctttagcatcttaattgagatataattaatttattatacaattcagcattttaaagtgtttaatgctttttatagtatttacaagtttgtgcaaccatcaccaccatcgattttaggacattttccgccccctccaaaagcagtgtcgtactcactggcagtcactcctttaaccccttcacccacctctagccctagccaaccgttcatctactttctgtcatagatttgctcattctgggcatttcatgtaaattgaatcgtataatatgtggcctttttgcggctaacttctttcatttggcatgttcccatggttcattcaggttacagcacacgtaacacctcattcctattttatggctgaatagtatttcatggttcactcacgttacagcacacgtaacacctcattcctattttatggctgaatagtatttcatggttcattcacgttacagcacacgtaacacctcattcctattttatggctgaatagtatttcatggttcactcacgttacagcacacgtaacacctcattcctattttatggctgaatagtatttcatggttcattcatgttacagcacacgtaacacctcattcctattttatggctgaatagtatttcatggttcattcatgttacagcacacgtaacacctcattcctattttatggctgaatagtatttcattttatggatatatcacattttatttatccattcattttgttgatggaaatttgaattgtttctcctttttggctgttatgagtaatgctgcagtgaacattcatgttttttgtgtagatgaacgttttcatatagtaactctatgtttaatgttttgaggaactgccacaatgattttccaaagtgacggtaccattttacattctcaccagcaatgtgagaaaattgccaatattgtctgtctttgattaagccatctagcgctatgaagtgtggtatctcattgtggttgtcatgcacattttttttagtggctaatgatgttgggcatcttttcatgtgcttattggccatttgtatatcttctttggagaaatgtctgtttaaatcttttgcctgtgttttaattgggttatttgtctgtttaaaaattcaattgtgtttttacatatatacaagttccttacccaatggataatttgcaaatcttttcttctatactataagctgtcattttactttcttttttaaaatttatttttttcctaagtctgttgtatgcagtctccttttacttttcttgatggtacgtttgtaatgcaaatgttttttaattttgatgtagtttaatcttaattttaattttttcttttatcacatatgcttttggtttcatatgtaaaagccattgtctaattctaggttacaaagacttacttctttgttgtttttcaagagttaatatacttttagctcttctattcaggcctgtggttaatttttatgtatggtgggagggagggaggtatttgcctattattttgcatgtgtatatccagttcttccagtatcatttgttgaaggctattgtttccccactgaattgtcttagcaccttttttgaaagtcagttgaccttaatgtataggttcatttctggaccctggattcttttccatttatatatatgtctatccttatgtcagtcagtactggtttcaaaaaagaaagaacattttgtttttataccatcgtatgaaaggaaaagagtaaagaattaattacaaatgttttgagaacctgtaaaatggtctacaaataagggccctttcttccggtgagtataagtgtaacttaaaaaatatgtaacttaattctgactaaatttatacaactgtcttgatacataaattgtcagttctttatgatagaattctgaactacaatttggattctagacagctttatgaatattgatttttgttttttcccctcagtctattgtgaaatgttgtgatagaactgagcagaagagaagggagagaaggagtgtgcaaaaatctgaaagagtgactttaaaggttttctacatttctctgaagcgaatagttgtcaggtatttatgagaaattgcatagattgcagctgatatattatcagtgaacaagacacagtatctgtcttcaaggcacctacagtctaatagagaaagactatcaagtaaacaggtactgtttcagaactgctttgatgggaaatgtaggctgctatgagaacatctaagggagttcatcaggggtatctgaggatagtttgggaagacttcttagagtaactggtatttaaacagttaggtgttatcccagcctggatgagaggttagggaagtgtgagagtggactggaggaaagagtttttaagcaacagtctggaggcaggagactgcaacatactcagtgcaactgcctggagaaggatggatgtagaaacggtgatagatgggagattagcaggggccagccagaaatcttgaagtcgtttttaagaagtgtggacttcgtgttgtgggcgaagagaaaccattggaagattttaagcagagtactgacattcaaattatcctctgaattctaggtagctaagattattattttattcttcaacagtttttattttaattttgcttaaaaaattgcctggtgaatcttactgtgtcttttatatatatcccaaaatattgctttattttaccctttcctcttatccttggatgataatattgcttggagcaagagtctaggtcaaagccatttttcctcagtgattggtagttatttgtccactatttttgtgtgtccatgcttactgatgagaggtctgatatcagtcttgatttttattcttttctgttagtagcttttagggttttctcttttttttttttctttcccccagttttccaagaatgtgagactgtgggttttatttatcttataaaagtactcagtgagcacttttagtctgaggactcttgtcgcaaactctaggacatttcttggtcattatttctttaggtactgcttctcctccacctggtttcttatacatattaaaatttctagatctgttttttagtcttctaactttcctccgtgttttaaatttttataatttttatgtgatgtgctctaggaaaatgcctcagttctgtcttacattttactgattcatacgtctactttgtttcactgcttacttatcatgaccttctgttcttttttataactccttattcttaatttttggatctaaatcctgcttttatttttctgaggctctgaagtatttttatttaaaggttttttttttttttccttgttgtttggccttttaactctgttctttttggatgtaagggttgttcttccctcatttgtttaaaggttgtgtgctcatatcatgcaaccatattctcttccttatgtcccagttgcaaattatctgaataggtagtttgctggggtagctttctggctagcacccttgggagtggctgatggagatagccttggctcacttccaagatttcctctttactgttttcttcttggatgccttttagcctctgttcctgagagagtgctcttttatgttttggaaagagttctgtgtaagcaggggagatttcatcctatgtggttctattttcctgaaaccaaaagaagtattttttgtttttcctttttttaaaaaaataaaagtgaaagttacttttttcgctttttggtttttatttttagtattttttcttttttttgtacagcaacctctgatgccaaacaaaagaagtagtttttgaattctaaattttctcaagagagtgcacttactaacgtaattgatacaagatgtcatggatggtggtatgtctttggaaaaatggcactaactgataaaacaagaatgaaagaacagaaaaacattccacgagaggtgttttacagctggagatgaggaagaccatcctcacaaatacttagcagaacttgtctttggcaggttctatagagtgggaggtatgggtcccgagtgtgatggctcacgcctgtaatcccagtactttgggaggccgaggcaggtatctcacttgagcttaggaatttgagactagcctcggcaacgtggcaaaaccccacctctacaaaacagacaaacaaacaaaaaaccaaaaattagccaggcatggtggtgtgtgcctgtagtcccagctactcagaggctgaggtgggagattgcttgagcctgggaggtcgagtctgcagtgagccatcagtgtgccactgcactccaggctgggtaatagagtgaggccctgtctcaaaaaataaaataaaataaaaagagagtgggatgtataatgatggagggtagaaggaaagtgtgttcaagagaaatagactggattagcttaagaggcagtaaggatcaagaactatagccacaggtgaaaataaggtttgaaatggcttgcttaatgccgcccaacagtggaatcccatcatactcctggagttagattctcaatttagaacctagagtgaaaactatatgttataaaaaaatcatcctaaaattctataaattactcctcaaaagacagtatcacatggccgtatctgttgtattggagactggcaagccccagctctcaatatacacagcgttaacagttactaggttgctgattttctttcattttttttttcttattttttatttatttattttcgagacagagtctcactccctcacccaggctgcagtgcagtggtgcgatctcagctcactgcagcctctgcctcccggcttgagcaattcttctgtctcagcctcccaagtagctggaattacaggtgtgtgccaccatgcctgactaatttttgtatttttagtagagacgggttttgctatattgtcaaggctggtttcaaaatcctcacaagtcatctgcccgcctcagcctcccaaagtgctgggattacaggtgtgagccactgtgcctggctgaaaatatttgtctgttaacactagcgtctcattcagttcagtgagatgctcatattatgagaggcatgcaagaactgagacactcggagagaacagaaaagccccatatctcatctcacagctgtctaggggatatgttcattgagtggaattgcatgtgggattgcttacactacttaaattattttcttttttttagctttttgagggcatgtcttcatttaaaatttaaaaaaattttaaattattttttattttttgagacaggccctcgctctgttgcccaggctctggagtggcacgatcacagatcactgcagccttgacctcttgggctcaaggatcctcctgacttggcttcccgagcagctgggacctcaggcatgcaccactatgcccagctgattttttttttttttttttttaagtagagacaagagatggctatgttgctcaggctggtttcaaactcctggcctcaatcaatcctcccagctcagtctgccaaaatactgggattacaggtgtgagccaccacatctggcacacatatcttcattctaagtaacagatttcaacttgttcttgacaaaaaaattttaaataacagaaaagtctacatatttgatattcactttttctcagccatcttctcggcccttatgtcaggatatgatgaaaatgcatcatacatttaattcatacagattgaagatgtgccctgggctggatgtgatggctcatgcctgtgatcccagtgctttgggaggctgaatctatagcttgaggccagaagtttaagaccagcctgggcaacatagtgagacccgcatctctgcaataaaaaagaaatagctgagtgtggtggtgtgcacctgtagttccagctactcatgaggctgagctgggaggaatgcttgagctcaggagtttgcaactgcagtgagctgtgatgatgccactgcactccagcctgggcaatgcaatgagaccctgcctcttaaaaaaagagatgggccaggagcagtggctcatgcttgtaatcccagcactttgggaggctgaggcgggcagatcaccgaaggtcaggagttcaagaccagcttggctaacatggtgaaaccccgtctctattaaaaatacaaaaattagccaggtttggtggcaggcgcctataatcccagctactcgggaggctgaggcaggtgggtcgcttgaacccgggagcagaggctgcagtgagccgagattgcaccactgcactccagcctgggtgacagagggagactgtgtctcaaaaaaaaaagagaaagggatgaagatttgcgttatatttgggttttttctttaaacatatgtgtagcagtgtatgtgtttttttataaccaattcaaacagtcttaaatttgtgctcatgtctttgtttttatgcttacatattaacaattctgcagtacatcttgatgcataggattctttggatcaatttctggaagtggagttagtgggttaataaattagagtggatagtttgacctttcagatattggcagttgttatcccaaaaggtagaaaaatatgaatgctacattctgtacatattcatcaatgtaaaatattataatgataaatattttttgactactggtaagattgaactactgtttactcgtgagtttattggtgacttacatttctaaggtaaaaatctaggtttctcttttttctcccatcaccatttattgtatattgatacacattgatcttttatcatatgtattattattaaatatttttgagacctgttcctagattttctaactgggtttatttattgaggtctgattttcgatatgtgtttgtattatgccattttaaccatctggtgtgtagtaatgcatacttcttactttcagtgtattactggatagtttgatccatattttacatatctttgaacttcatagtcatgttcaatacgcctttctccctctaaatggatatatagtgggagtgtcagcctttgggattttgaccataatggctttaagtttgggataaattgacatttttgcaatatttagcttccccatccaggaatataggctgtctccccattgtttcaggtcttatttgactttcagtaagatggatttttttcacgtgttttatttccaactgttttgaatttttgtattttgtaatgttagatgaattttcccttgatcattttgttattggccctgctagctgatgggaagaaatcaggagtactaatttcaaatatcagatttccatggttccaagatatactttcccctaatattgaaatagtccttatattctatgaaaattttaatgtagtttttatttaccttgaaaacacatttatttaccctgaaaacacattttagttatgatgatatttatgattatgatttatgatatatttatgaggaaataaggcatattttctattagtatttggattttctaaatagataatcaaatccattactcaggttatttttgtctgtttcaggtagtttacttcatgtttctttcgtgcttcactggctagaacttttaacacaatgttaaatagtagatggttgtggaattctctcttgtttttgattttaataggactgttgtattttagggttaaatattgatcttgggtttggtggaaatgttctttttttcttttttctttttttctccttgtcttcttcccctcaggtttggtggaaatattcttaagaatgttaagaaagtatccctccatttgtttactggaggttttttaaaaataagaaatacatgttaaaattatcaaatgttgtttgttgacctagtactaagatttttctcactggatctatttgtgatacattatgttaatagttagcctaatagtagactatattcctgatacattcgtattctttcaatatatagcgctgaatttaatttgctggaacattttaaaaggattttttggggtcatttgttagtaagactgatttatagcattctgtctccctctggcttttttttttttttttttcctttgtgagggtttggtgttacagttatgctagctctatgtctatcttttcctggaacttttattttctttcatgtttttataggactgatctgttgttgaaagccttgcccatgaaattgtctgcactcagcttttttggggtattttattttattttattttattttgagacagagtctcgctgtgttgcccaggctggagtgcagtggcatgatctcggctcactgcaacctccgcctcctgggttcgagcgattctcctgcctcagcctcccaagtagctgggattacaggcacccgccactatgcccagctaattttttgtatttttagtagagacgtggtttcaccatgttggccaggatggtcttgaactcctgacctcaggtgatcccccggctttggcctcccaaagtgctgggattacaggcgtgagccaccgtgcttggcctttggggtattttaaatgtacttattctcttctaaagtcagttttggtaatttatattttcctacaaaattgtcctgtctttaaattatttcagcttaagagttattctactattggacctgtatggttttttttttgtatttttatttcttatttgttatatttgtgttttcctcccttgattttcttgctagagatttgtattttagttttcaaagaattggctattagatttgttcattcaattttttgagttgtctgattcatcctacttttgtttgtattaattttttcttatttctgtttaccttaggcttgttttattgtctattttctaacttaaaagtttcatatgtggattgtttacttacccttgtgtagtaatgaaagcatttagttctgagattttgcttgttctctatttgttagatgaggctgttcaaatgttgacaaaagccactagaaagtctcttatcttttccttttagctcagttttgtttgttttttctttgttttttttttgagaaggagtctcactctgcctccagactggagtgcagtggcacaatctcggctcactgcagcctccgcctcctgggttcaagtgattctcctaccacagcctcctgagtagctgggactacaggcgcgtgtcacaacgcccagctagtttttgtatttttattagagacagggtttcatcatgttggccaggatggtctcgatctcttgacctcgtgatccacctgcctcggcctcccaagtgctgggattacaggcaagagccaccatgcctggcgcgtttatttttgattatggaagtataacatgccagagtatacaaattataagtgtacaactcaatgaattgtcccagggtgaacacatccatatacccaaaataaaggcagaacccttctagcactctaaaaatcccctcacagatcttaatcactaacaccgtttatgtttcccaaattggaaatactatcctgacttctaatctcatagatcaattttaccagttttgaactctatgaacagaaatgtacaaattgggcccatttgtctggctgatgactgggtaatgggtctggctcatgatgtttagtgtatccatgttctgtgtattggtggttcgtttatattcatgctatatagtatagtattccgttgtgtcctgtactaccaagttattatccattcttctgttgatgaatatttggtttatgttcagtttttggtgattatgaaaaaatatactctgaatattctagtacatttttgggcacatgcatttgtttctgttgggtatatatgagtatgtatgcatatgcacaaaatatatatgagtgaaactgctgggtcataaaaggatttatatattcagttttagtatgttttgccaaccagtttcaaaaacggaggtaccaattcatattttcattagcattatatgtgctttccatctgttccacatccacccccaagagtttaagccaagttatttagccagtggatttagaaacacatatatgaaagcatatgttataaatgtactttatttcactatgggtaaggattgtggcctacataacttttggtttttggaaatttgagtttgtctttttgatctgatgtatgattgaatatttcatagggactagaaaagtcaaaatgtcctctctttgtaggtgtcaaagtataatagacattaggttaattttattatgttctgattttctatatcattactttttatttattgacttgacagagataaggaaagattctcagtacttttgactgtaaaacctctcagtatttctgtcagtttccttttattttctaagtttttctttataaacttcagtgttaatgttatttggcttaatggatggttttacatgaattaggaattacattttattgctctaatatgggaatttttttttggatattaaattacatatgaccttccttagttacaaaaaaaaggttgataattcattagtatatctttgccataaatgtagaaatagttacatattcatgttaccctataacaagaagtaaaattcagtaacagcagcgattatatagctaattacatacccaagtgatgttcagggtatgtctgctatattagtacttaattttaatttcaaaaatgccttttaagaagttgctaaaatgtcttaacagggaaatgtaatgattttcaggtttttaaaaatgaacacacataattcaggcattattgtgaattattgtgtattgaaaaattaagaaaattcgttgagtcacatcagtttccgaaagatgcaaacaaatgaaaaagggaaaaacaaaatccttcaattgagtacaatttaacacaatactctctgtgatttctttcatactacttaacataagcatagaggttttgctttttaaattgagatataattcacatctagtgaaatgcatatatcttaagtgtttggtttgatcagttttgacaaatgcaaattctctgtaatccatttgcctatcaaagtatagaacatttctatcatctcagaaaatttcttgggcatgccttttctcagttaatccttatcctctccacccccttccagcaactactgatttcatattagtttgcacattctgaaacgtaaaataaacggaatcctacaggtcatgcttttcttttgttctggcttgtttcactcagtatctagcttggagatccattcatattattactgactagatcagtaattctgattgctccacaatcttgccgatattgggtgatactagttttttttaaattttgattttagtcactctaatgggtgtgtagtatgtacacatagtttaatcatagtgtatatgcagtctccctctcacttcagtgtttgatattaactgaatgataatttctgagcttttgtaataagacattgtgtgagtaatgactatggtttgaatagtcatttgaaaaggaatttgcatggccagtttgttgtactgttgtaaattaagtgaggatcataaagctgaaagtgaatttagaaatcatttaatagaagcttctcagtttacagatgagcaaactgacctacaaccttaagtgacctatttaatgatacacagcaagctaatgctgaatgtaggtgtatgatttttgattgaatgtttttgatctaatgcttatttcttccaagttatttcagagattgtgttattttattttctttgtaattaatgaatagtgttgtttcacaatactttcagaaaatgtttgttttagctgggtacagtggctcatgcctgtaatcccagcactttgggaggccgatgtgggtggatcacctgaggtcaggagtttgagaccagcctgcccaacatggtgaaaccctgtctctactagaaatacaaaaattagctgggcatgatggtggacgcctgtaatcccagctgcttgggaggctgaggcaggagaaattgcttgaacccaggaggtagaggttgcagtgagtcaagatcatgccattgcactccaacctgggcgacaagagcaaaactctgtctcagaaaataaaaaataaaataaaatgttcgttttatatgagtttgacaaagggaaagagcttaaagtaggctccatctaaattcccttttcagcattcctttttttctccatatttctggtcatgcaagaccagaagagaagaaaaggaaaggtgggaacaactctgagaaacttgcagttgagggtgtcataagaactccttttaactggtttcttcccatttgagtgttagaatgaattgaattctattgtttaactcggctttaatgttcctaggtatgcaggtgccttgagagcttcaggggaaatggcttcagcgcagtatattactgcaggtttgtatactaaatatactactttttgataggagtaagacattctatttttcgctcacaatcctttgcagtttacagaatgtcttttgtaaaacatcacctcattaagcctggagtgtacattatacttaagttaaacaacttggtacttattttatcgtccagattataaatcaatgatgtctgtcgtttgtgaaaaataatctttggatttttttggattaaattataattttggcttcaggtttgatttgtataatacatatctttggggttgactctggggatagccagcgacgggttttatcataatccatgtatcattataaaagagggtcttagtgaatattggtgtaaagaagtgatgtgtgtgaggagaaatagtaatcttaaaggatagaaataactggtttcttcattgcataagagaatataacccccacctaattttggacattttaatactgttaaatctttgggttaggtcaatagggttttacagccatgcctttttttttactctctctctaacagctttattgatatagtgtacatatcataaaatctgcccatttaaagtgtataattcattgttttttagtttatccacagagttgtgcaaatattactaaaatgttaattttagaacattatcattccaaaaagcaacttcataacatctagcagtcacctcctttcccatttctagccctacccatttatctatgtgttatttctctctagatttgcctactctggacttttactctaaatggaattaaataatatgtagtctcttgtgactggtgtctttcacttagtataatgttttcaggattcatccacattatggcatgtatcagtacttcattcttttttattgctaaataagagtgccttgtatggacaagccacatatcatttatccattcatcgttggtggatatttgggttgtttctgcttttcgactattacaaatactcctgacagtcgtgtacaagtcttggtgtggacaaatgctttcatttctctttggtatgcatctaggagtggagttaattactgggtcatatgattactatatttaaccttttgaggaactgccagaattttccaaaggagtcccaccgttttacatttcccccagaagggtatgagggttctgatttctctgtctccttaccagtacttagtattgtatgtctttttgactatagccatccaagaggtatgaagtgttatctcattgttgtcaaccattgatttttgatattataaacaggtttcttttgtgtcatttgcagttagagagattttactctaact

SEQ ID NO: 1997 - DNA, 30987 bp, Homo sapiens
aaccaattcaagaactggtgaattattttccatctggaaacactaaacacacttctgagacaaaccccataatatcctaaagacaaaccccataatatcctaaatgtgtgcttcaaaaaacttgaagtaaactgggtgttgtggcttgtgcctgtaatcccagctgcttgggaggctgaggcaggaggattgcttgagatcaggagttcgagaccagcctgggcaacaaagaaagaccccatctcaaaaagaaagaaaaagaaaataacaaaagcttgaagttcataattccaattctctgagaaacaaactcatgaaaatgaatctccagctcaggtaataaagttgttctttttcaaatttgttctgctctttcttctctggccaatacaatcacaatccctaaattaatctttgcaagatgtacagagaaatgactagggcaggagtggcaattgggctataggctggaccttatgggctctcttccccatccagccttaaggaagtatgtactcctaataagggaatatgtaaatacttcttttaaaacacagaaaagccaccacatttaataattactatgttgtagtttccaatgaaagaaactgggaatctaatcttaacagctttctctctgggcacttggaggttatttgtgacttcagtcacttcgctcagtaggatataatgctcagaatgggtaattctggaatgcttagtatttttcaactatggattttgtattgctagagataatataacagctctagtagatgtaatcttgtctttctgcccatttgtttacagtgtcaaaattacctatttgctaaatttaaaaaatcattcttcatgaaattctcttattgaaaataagatgtactaatatgttcgcaagtttaagtaaaagacaaaccccattatatttcattgagagaaggatgaaatgaacggaagtaaacagtgctttatttccaatctcgagaaactaaaggatactccctgagaaaagaaaaacaacctttcacactcaattcacttcattctcctccactctctaaggctctattgtgggctcgctctgcttaagttttctccctcatcattttctaacatacgatatagtttacttagtatgtttattatctgtctccactattatgtaatgcaccagggcagaagttttgcttttttcatggcagcatctaaagtactgacagtacacagcaggtgctcaataaatatctgttgaatgactaaaagtgaatcatttcttcaggagagacctgctcatgatatgccaaataggctgaaggctaaagaatacagtataacagcagtctaatacatatatatatatatatatatatatatatatatatatatatatatatatatatatatatttgagacagtcttgctctgtcgccaggctggagtgcagtggcgtgatttcggctcactgcaacctccgcctccctggttcaagagattctcctgcctcagcctcctgagtagctgagactacaggtgcgcaccaccacgcccagctaatttttttgtattagtagagatgggttttcaccattttggccaggatggtctcgatctcctgacctcgtgatccgcccaccttggcctcccaaagtgctgggattacaggcgggagccatcgcgccaggcctacaaaatattttaatgttagcaatagcaaggctcaggtggaggcaacatctaagttcattataaacaattagcgatgcattgagttaaacaacaaagaaagcctgaaattccactagcaataattccgcatgtgttacggaaacacctagatggggactgttgccgggtttgaaggctcctccgtttgctaaaacttccagcactagagagtttattaaactactcctccaaagcaatgtgccctcactggcccctccccttgagaatcaacctcgagatctagcatctattttgcaaacgaagacagcaggaacgggcgggctaaccgtcgcagtcactgcctcggcgctcctccccctccaaggccagcaagttgcggcactgggggaaatggccgcggcgacaacttcctcgagttctctcgggtcatcgtgaacttgggcaccgaaacgaggatccaccccctccccaccaaagtgcgggagggaaaagaaggctagccagcgagaaattttgccccacaaatccgccagcagcagtggcgggaagcctcaacggcagcgaccccgccgctggcctcgtgcgcagctggtccccaccctcgcgcggcgctccctgattggctgctggcggcgggacggggcggggcgggatggcacgttgccgctgcgcctcgggcctgtgcgggcagtcctccttcacttccccaagtccaccctgactggcttgggtgcacagccagggctagagtgtccgggtcccgcctgggccacaggcgggccctgccaggtctctcagaccttccggtcctcgctgaccagtcggggagtggaggcgtcgaccgccctggcaactcctcgccttgggcggctgggtcgagttcggccgcagggagcgtcaaagacgctgcctagcccaatttcggcgggaaagcggtttacctgctcggacttcgctgggtgcctggcagcccgccgcctcccgaaacatccacgcctgaggtcccctggcccgtctacacccagtccaggccccgtggcggcgcctttctgacccccatgacacagccagacgaggtctgcgggcgggtggctcctggcagcggtcgatggggcacctggccacgtttcttcccaaccagatagcgagcgtttggggccttcacctcgcccctccaagccctcagggacaggctccacgctgctccttctccccgctatcccgcgccctggggccctgatcgccgtactcaccggcccggactcggtttccatcttcctctctgctcttcagagacgcggggtagggaaaagaagcctaaagtttgaaaccaccttcacgccaaggcagcagcgctgcttgtcctgcctgggactctcgccccctggcggcgagggtggctgtggcagctgcagggaagcaggctcggaccccggccctgaacctgccacctggcgggtggggagaagcggactgcgtcgcctcgggtggcaggtggcggtgcgggcgggcgctgcaagccggagaggggcgcgggagggcgagtttcggctgtggccctgggactccgagccggggcgtctcaggggcagagcgcacggcacagcggggcgggcgtggggcgtgcggagcgagggctcggttctgggacccctctcgccttctctcagacggctggggaggagagagcgagcggtcaggcaaagctccatgcacgccttcccctctcctccacttgagaagagtcggcctctgggactggtgggtttcgagaggttgaggtgaccttaaggctttactgaggtagaagaagccggttgacgggcgacttccgaagactggtgtaaagcgaagaaggttctagagtcaaactctgactctcggggcctgactcgcaaaactcgggggctcccgagaagccgcggacgccgctctgcacctgttgccgccgtcactcatcccgccaggcgggcggggccgcgcgggtggcttggtcaggacctgccattcagcccagtcgggctccggtgctcgccccggacggcgccccaagcgggtcccggccccgctgagcacctccagcagtggcacagcctctggaggggtccgggacgaagccacccgcgcggtagggggcgacttagcggtttcagcctccaacagccttgggatcgcctttggaagaagattgcgctttttttcttaaattaatgaattaatttactaattatttttatttttgagacggagtctcgcactgtcgcccgggctggagtgcagtggcgcgatctcggctcactgcaacctccgccttccggattcaagcgattctccttgtctcagcctcccgagtagctgggattacaggcgcccgctaccacggctaatttttgtatttttagtagagacggggtttcaccatgttggccaggcttgaacttctgacttcaagtgagctgcctgtcttggccgctcaaattgttgggattacaggcttgagccaccgtgcccgtccagttgactaattatttagacacgaaggctcactctgtcgcccaggctggagtgcagtggtgcgatcacgctcactgaattctcgacctcctgggctcaagcgatcctcccacctcagccttctgagtagctgggaccacaggcaggcccacgccaccatgcctggctgaaagaagactgctttgtaaataatacgtatttctagtaggtagctaaaatgattacaactggataaacttatagtaatgattatcattattatagctgccatttatcaagtactcactttgtttcaggcacaatgctttatgatcagtatcatttaatcttttcatgctcacagcaacctttcagatagatgctccaattatcgtcatagtacgtgatgaagcagagatttgaaggataagtaatttggtcaagatctaaagctgtaggaggtttaaccctcgtctcccccccaacccacagttcttgatcataaccattttgccacatatttttaaagaatcagcagtaacaactgttaaaatttacaccagtaataactattgtacacactactataaaagtttgactttgggttactttgccttcaagatatagaattaaaaacagagtgaatatattaatttttgatttattcaaagattagctcttcatattattttacccaaaataaaatgggaaacaatttttgtttatcttacccgaagaatccctaaagtcattatacatttctgcatgcaatttaagctcattttaccaggtttcagtctctgtggaaatcgagaatacaaacctatttagatgaaaactcatattctaaagcataataatcttactgttcaataccagtagaactaatcttctttgggcatttttttttcctaggactgttgctggatttgggtagatgttactatcctctcttgcccaaaacattttgactaaaaacacttattttcaagaactacattctcttaaaaaatgtattcagcgcagtaggtgtttaatctgacaaaaatttacgtaatttagggaacgctaactgtatttcaaggctggtgttgggtactagagggatatactttattttcagtgtggcagttctctgttctgcctcttactattaattcttacaccaaaaggaaagttcagctttaaaacttggataaaccacataaaattatgcaatgcaccccaatttagtagacacttaacagagttcctattctgtgcagtacataatggaatataatgtgggagatatgaagatgaagaacaggggtgtccaatcttttggcttccctgggctacattggaagaataattgtcttgggccacacataaaatacataaacactaacgatagcttatgagctaaaaaaataaatcacaaaatctcataatgttttaagaaagtttacgaatttgtgttgggccgcattcaaatgcggcccatgggccaccagttggacaagcttgaagaacaaggtcaaacctctgttctcaaagcattttaaatctagaaggatagaaaaaactaattactccaaacagtataatataaatatgcttataagaaaataaaatacaggcataacaggctgagtgatatattaacaatgatcaacggtctgtgggagaacagaggatagcatcatagagcacagtgtccagggctgggtaagggcattgttaaggctggaatgctggtctgggcagaaaaattgagggaaagatattgagcctgcatcatgtacctaatgctgggctagccacattctttttaagtcttagttctctctttttcttagtctctctttttctctctctcattggaaacctgagtcttagagaggtaaaagtgactctcgtggtcacattgctagtaagtggtggatgtcattttcaaaactttgttcctttttttaaattataccttaagttctagggtacatgtgcacaacgtgcaggtttgttacataggtatacatgtaccatgttggtttactgcacccattaattcatcatttacattaggtatttctcctaatgctatcccccccctaccagccccctacccaacaacaggcactggggtgtgatgtttcccaccctgtgtccaagtgttctcattgttcagttcccacctatgagtgagaacatgtggtgtttggttttctgtccttgcgatagcttgctcagaatgatggtttccagctgcatccatgtccctgcaaaggacatgaactcatccttttttatggctgcatagtattataccatggtgtatatgtgccacattttcttaatccagtccatcattgatggacatttgggttggttccaagtctttgctattgtgaatagtgctgcaataaacatacgtgtgcatgtgtctttacagtagcatgatttatgttcgggctcagtgcactttgtcatgttacttatactatggcaataaagagaattttattctggagacctttgtaaatagggaccattgaagatgattgaaccaggaagttgtataatcagagccaaattttaggaagatattttcatatcaaagaagagtttttgaggggcacagactggaaacagatagttgaatttggaggagaaaacaattcaagtgaaaaataatggggacctgaacaaaggtgacaggagtgagaatcaaacactgggaaaaggttaaagagataccagtgaggaattgagactgttgggcatgggtgatgatggagagggattggtgaggctcattcagaaatctggtttcacatatgggagatactgtttaccaagataaacataaaagtatagcacattacaaattgcaaacctaaaaatcccattttcttaagttttctgccaggttcccaatgtttctcatcttttttcttcgcacaatctgttcagaacatagtctttgtttcagggatttacccaactacccttctttcttgccttccctagttgacagttcttcccttcttgcctcttgagttttctaacttcagattgaagctcctaatatctacttctggctctcattttcttgataaccctttggatgcattctctagtttatagatgtggataactattttgttcctcctgtgggcaggctttatgctatggcatgggatacagcaatgattaaggcctagttcttgctctggtagcaagacctagtggcagcctgtgatctagtgcaagaagcagctaagcagcctgtggtctagtgcaagaagcagctaagtaagtaaaaagtttatacattcattgtgctaagcatggcagtagaagagttgccaggtacagagatagcccagaccagggagtgatttaacttggtagataaaacaacatgaaaagacatgtttagaagatgcctctgtttccattttattttttttcttgtttccagatctattaacttattgtttcattttggaggattttaggtgctttctttttctctgtaatggttggatgtttgaaataggagaggtgagggatagagtttaaaaaaatgccttaagaaagcaaagaggacagctcagatcttcttttctcctacagggagcacaacacttagacttggagaggttgttacagagacgaagactagaacaatatttgatttattggattttttttggtaaaaattagttcatttatttgcttacgctgtttactgtgagcactacttagatacaagaacatacaatatagaacctactgactagcataaagtatgaactcaaaaaatatttgtagaataagggaataaatgaacagataagcctcaccccataccacactttgtctaagtccccaccatttgattcttactttagacatttggaccattaagaggctcaccagctggactgtcctctaatccttatcggtagaatgagatcagatacttactttcttgtccttaactcacagaagtgaatttggacatgtttaactgtaaaggaaagttttagttgtgatgcttagtaagaggtggctttttttttcattaagatataaactaggagacttcttggtactttagacaggctagctcatggctagaacacaactgtccttctagaccactatgacatccttctggattaagagtgaagaacaattgattattgccagataacctttttctttgttccttttccccctcaatggatatgtggattctaaattttaattgatttctcctgattgattttcccataacaatttgtgagagtacagattccttttcattggcacactgtaagttctcactctcggaagcttctgccagcctggtggtaggcaaatctaaaaagctcactggttggtcctttaatagctctgatgttctgtagttcttttttttaattgacaaataaaaatattttataagtgcatagttgtatatatttatgtggtacgatgtgatattttgatatatgtatatattgtggaataattaagtcaagtgaattaacatatccatcatctcatctgcttatcatttttcttgtggtgagaacatttaaaatctactcttttagcaattttgaaatgtatcagtaaaacttattcattctatctaagtaaaattttgtaccctttgaccaatgtcctccctttttctgtttctatgagtttgacttttttagattctctatgtaagtgagatcatgcagtatttgcctttctgtgcctggcttatttcacttaacatattgtcctccaggttcatctatattgttgcaaatgacaagatttcctttttaaaggctgaatagtattccattgtgtacatataccacattttctttacccatttatctgttgatggacgcttagattgcttctatatcttggcttttgtggataatgttgcagtgaacatgggagtgcagatatctctttgacgtacttgtttcagtttctttgaatgtatacccagaactgggattgctggatcatatggtaattctatttttagtttttttggagaacctctgtactgtttttcaaaatgactgtacaaatgtacatttccaccaactaggcttcccttttctccatatcctcaccaacacttatctttcacctttttgatgatagccatataacagatgtgaggtgatacatcattgcagttttaatttgcatttatttgatgattagagatatgtgtcaggtcttattcatttttgtacactgtgaacttaactctgtaatgacacataacagacattcaatattttatcttaaactattgaggtagagcagtagtaccccagggatatgggaataaaatattagagctcatatttttatttatctaaattgataagaagtaaatcaagctttgctaatgtttgatatgtagattccactcttacccttacttggtccatatatgggtaaaaatattttgagggaagattgggagttctagaacatggagaagttgacagctccaactcattgcctggtccatgagcccagctaaatgaattttaaattatgttgtgttagtttgaattaaactaactcaagatggatgcatggcttaaatattccagagaacataaatcaaagataattctagtgaacatttcaaaaattgcagagcgttcccttcttctattcttactacaagcacgtcctcagccacatcatgaagtaaaaacaatgacaatatatcttataagaagtcagctccccaaaattgactttttagtatgtggatgtacaccctcttccataaacaacagaaggccctaaatggatattgtttcttaagatattagctaatggtgatataaagccatcaccattagcaaaacattttaaagtaatatttgcttcatcttcttaaaactctttggtgtatgttttataatgtgcataaatactaacatagagacatagtaaatgatgggcgtcctcaaaaaccaacaagaatttgcaaacacaatgtgtggaaactcctacagaagagcatggtcctcaagatctgctttttttttgttttgttttgttctagaaggcagaggaaatacacacttaaaaaggcagacacacttaaaaagatgtaaatatagtacactgggtataaaaggtattaatggagaatacatggtaacttgagggttttggaaacactttctggaaaagacaatgtctgaaatgaattttgaaggagtgatggttagctcaaggaagagaggtgggaaagggatttcatataactaagaggtgaaagcatgaaatgcatttagtattcagtggatttcaagtagtctgatagtcctagagtgtgaaagaagagaagtggtgtagccagagaggattccagggatgtagataggagccatggccatgtgtgccaaagagcctggactctattcagctggcactgggaagccaatgaatcttaatagcgggaagtcagatttgtactttacagaaatccctctatctacaatatagagggaagatggatattagaacataacacatggtcactgtaatcaacttaattggtattggatgggaatcaggacaatccaaaagtagattgaagtacatgtagaaatgtgatatatgacaagaaggataattctattcagtgaggagacaataggattatttaatagcgttggcacaaatagacattcatctggaagaaaataaaaatagacccccatcttattttaaaaaatttatttgacacttatacacactcattaacacttatataaatataaaaaccaaatttagaaataaattataaacagaccaaatacatagtttcaaaaagaaataaaaatcttgcagaaaaaggtaggatttacatgtacaatctaggggtggaaaactgcattttaatcaacagtggagactcaaaaattataatcaagctgatagacattttttgattctgtgaaaattaatataatgtgcaggcaaaagtttccataaagttaataaaggattattctagatagctattaatgtagatgacataataaggataatatttacaatgtgctgattgagttctctgggaagcatatggagttaggggtgcaaaaggtttataggggtgcaaaaaatatttgggggaaaagggaggagcaggtggtgccatcacttctgttacaagctgactcagccagccaagtgggagctgtggagcaaggatgtctgttggtggagtcctgtgatggtggaaatggagaagggcatgccctcagctatcactgcctcactcattcattggccatgggctgcctgaagaagaactttatgatcttggttcaaatttgaggtggaccctgaataagtgaatagctgcaggctgtcagtgaaccttactcctcgcagctggggactgagtcctttatcgtagcagggtctgggtgtggcaactccatgtttgccataaaactcttacaaaatcctgagaaaatggcatttgatccaatagaaaatagggctaagcacatttgtagacaacttactgaagatcaagaccaaatggccaagaaacattggaaacaatgcttagtaatctggaaagtgaaaattaaaataacaatagactataactttatacctataatagtcacagaaattaatcagagctacagtaccttttaaggtggaatgtgaagtattgtagctctttgggaaagctatcaggcattatctatcaaaggtaaatatacgccttagaccctaaaatttgactcctgggagtctatcttatacaaataaaacctttggttcataaatatgtgtataaaaatgatttttacaacattgtttgtagttgtgaaaaactagaaataaattggataccctaaataaggcaatggctgaatgaattatgatatattcacaccatggaaatactatgcacttatttaaaagaatgaataagtagctattgcagaagaggtggtgggattttttactagctcttattgaatgaaaaaagaaaaatgcagaggagtattgtattagtctgttctcacattgctgcaaagattctatctgagactgggtgatttataaaagaaagaggtttaattgactcacagttcagcatggctggggaggcctcaggaaactcatggtaatgatggaaggggaagaaaatatgtccttcttcacagggtggcaggaaggagaatgaatgaatacccagtgaagggggaggccccttttaaaaccatcagatcttgtgagaactactcattatggtgagaacaggatgggggaaaccatccccatgattcaagtatcttcacctggtccttcccacaacacatgtggattatgggaactacaactcaagatgagatttgcattaggacatagccaaaccatatcattccacccttggctcttcccaaatctcatgtcctcacagttcaaaacataatcatgcccttccaacagttccccagaatctcaactcattccagcattaactcaaaagtccaagtccaaaatctcatctgagacaaggcaagtctcttccatctatcagtctgtaaaatcaaaagcaagttagttacttcttagatacaatgggagtacaggcattgggtaaatacacctgttccaaatgggagaaattggccaaaacaaaggggctacaggccccatgcaagtccagaatccaatagcgcagttactaaactttaaagttccaaaacgatctcctttgactccatttctcacatccagggcacactgatgcaagaggtgggttcccatggccttgggcagctcagcctccatggctttgcagggtacagcccccacctcctggctgctttcacaggctggcattgagtgtctgcagcttttccaggtgcatagtgcaagctgtaggtggatctaccattctggggtctggaggatggtggccctcttctcacagctccactaggcagtgcccctgtggggactctgtgtgggggctccagccccacattcctcttctgcactgccctagcagaggttctccatgagggctctgcccctgcagcaaacctctgcctggacatccaggggtttacatacatcctctgaaatctaggtggaggtttccaaacctcaagtcttgacttctgtgggcccacagggtcagcaccatgtggaagctgccaagacttggggcttgcaccctctgaaaccatggcctgagctgtaccatggccccttttagccatggctagagtggctgggatgcacgaaaccaagtctctaggctgcacacagtaggggggccctgggcctggcccaggaaaccatttttttcctcctagacctccaggcctgtgatggaaggggctgctgcaaaggtgtctgatatgccctggagacattttccccattgtcttggcaattagcatttgtcttctcattacttatgcaaatttctgcagtgggcttgaatttctttccagaaaatgggtttttcttttctactgaatcgtcaggctgcaaattttccaaacttttatgctctgctttgcttttaaacataatttccaatttcagatctctctcaagttcaaagttccacagatctctaggatgggggcaaaatgccaccagtctctttgcatagcaagagtgacatttacttcagttcccaacaagttgctaatctccatttgaggccacctcagcctggactttattgtccatatcattatcagcattttggtcaaagccattcaagtctctagaaagttccaaactttcccacatcttcctgttttttgagccctccaagtctctaagaagttccaaactttcccacaatttcctaactttttttgcaccctctaaactgttccaacctctgcctgttacccagtttcaaagttgcttccacatttttgagtatctttatagcagcaccccactctaccagtaccgatttactctataagtctgttctcacattgcttcagagatactactgagactggtcatttataaaggagaaaggtttaattgatcacagttcagaattgctggggaggcctcaggaaattcacaatcatggtggaaggggaggcaaacatgttcttcttcatagggtggcaggaatgtgaatgaatgaacaccaagtgaaggggaaagctccttataaaaccatcagatcttgtgagaactaactcactatcatgaggataggattggggaaactgcccctatgattcaatgatctctagctggttcctcccacaacaagtggggattatgggaactaaaattgaagatgagatttgggtggggcacatccaaaccatatcaggtatatataagattatctctccccctcatttttttctgctaaacagtgacaaaatatactttgtttatgtgtatatatatacacacatatacatatacatagatgaatgttaacttgagttaccttgcaaggagtggggagggttgatgtgggtggaagagggaagatatgtccaagataggcaaaagaagaacaaattgtaccaaaaaagcatacatatgatctcattatgctataatttctaaacctagtaagaaaggcagaatcggggcttacacagcttgcagtaaagagataaatgagaaaaatgggtcacagaaatggaaatcattatatgcaattttattggatatataaaagtttttagtttgtaccagtttactagatgccagaaatgtttactggttacatgtgaatcaaacagtatccggccatatgaactgaaagcatggttgtggaaagcacagggctttcagtaaacttacatacctctatcactcagcagaggctaggttatattacagtaacaaatgaccctcaaatccaaggggtttacaacaaaggatgttttattgctcatgttacgtgtctattatagattggcttcagttctgctccatgccactttcactcaggattcagcccctgtctggtgaacaatctcgaggctgagaaaatgagatcatagttaaatttatgctggcttttaaagcgtctgcttagaaggggtttctttcactggtcaaagcaagtcacatggctgagcccactgtaaatgggatgaggatgtatgaccctcctccagggaggatcagtaaaaatcccccagggtataaagatctgctttatgacaaagagtgttaatgaagtgtttccgtgtgatcacagtagtgaatgttattaatgattggtggattaatgagtggtgagaattaagatgagaaataagaggaaatacattgtgtatgctactttttataattaaataaatgctatttttattatccactgggtgttaagtataaagacactccttttgatttttttttgtttcaatcacagatcacagaccatctcatcacattttcataaaacaaagtaaaatctctttaatccatatcctgaatatagaaaaattatggtaggcagaagggtaaaattttaactacatattttacttttctgaattttagaattcacagtagcttattgatgagaaatataatgatcatcacaaatcagaaaacatattccttcctttataaattatagtataaaatagtactgttttgtggtttttgcccagagttaagtatttgcttgtcaaagaatcttccaagtagattttatctgcagctatcagtttagttattaaaatttcattttggttaggagaaaatttgaagaaagtgccgcaacatcttattacacaaaatgtacggtgcttcttacttgttattctatttcacaagttaaattaaatttcagtcctttactgttgtctaatatttcagatgtttcctacaacatacttaaaatttcaaaaacaattgtaacattatctgaaatgtttcaccagtacaatttatacagaacagtgaatggcaaaagtcccaagtgtggttcaacagctgttgctcccgtactgtgggctgagtagaggcagttgtatccatggtgacctatatgacttaatgagagtgggaactgcgtgattctcacaggggttaatgacagagcaaacgctggcaagccagctttcatgaggcatttggcttttttttgtttgtttgtttgtttgtttttttttttaaaaggaaggattcactttttctaactcctcattttgtaaagcagacaaacttcgtatcatgcttaacaaaagagctatatacctgaaaactaactcggaaaaaaagggcttacaaaacaaactatactttacttttgtcctatattttaatgtaaaacatgcattatgattttatatttattcaaatattgcactctgcttcttcctcccgaaaggtttaaggtagactagaacaaaggcatatcaataaagtctataaaataggtgtaagagtcttacacattatgagtggagaaaagaagtgcattagaaaaggaaatatgactctgcagtttcttccaatgggccctgtgacactaaaaagcattaataaacttcataccttggtataagttggaggattaaaaaccccaacatcgtgtaggtgatttagatttgaggaatgtacctgggatttgggggctcgaggggaggaggaacctactgtatattcacttctgcattgaaaatgtcaggcattgggtgtatatctggtttgaaaagatttctgtcataacgttgtacctggaaaagattcggttgtcaaataaaacagagaatcaagtttttatgggggccttatttgtgccatttcagtggtacttttcctaagtgcctctggcttctgcatcagtgggggaaaaaaccgtgacatgagctccaactccaggatccacgtcaaagtaagttaatacatagaaaataaatcaacactgtctatttttaaaagacctttgccatgcacaatacagactactgccagatgattggcctggagctcctgatagtgccttagccccagggtcttcatggggtaattcctgtgggaatggtgttaatggatagaggcccaggcattctgctctcctgcagacagtagagatttctcaacctctgaaagaagcagcagtaatcagacattgaagaacattggctgtaattaaagatttcttagattcattgcctctcagtactttaaagatttattaaactggggaatctagacctattataagcaatttgtaacttctcatttttgtaggactgttataatggagcacactttacttgttctttgaaataagattagttgatttttatgttttagttactgaaatttcttaattcctaatataagtgacaaaaactttcaagaaaaaacttgaatttcaaagaggtcatatatcaagttttgcttatcttttattgacttgtatgtatttactctactataatattcactctacaaattaccctacaaattctgttttcttgagctagcaaaacaaaatgatcaccatgtatattggggagggctatgactgaatgtaaagatgcatgcaacttaactgaaaatgctgtatgtcctcttctttgattacgtgcaatgcgtcctttaacttattaggagacctgtctcaatataaaaatatttttcttacacatatgtgaatgagatgataaatgtgtttcctcatgcactaatgaatcagtcatactggtggtccatgctgatgacataaaggtcatgttgatgttgagagaggaggttgtcatggttaatatgagtggtcccagatctgaaggagtggctcttcattctccaggacagctactggacttgtatcttatgagagctttgggtagcaggaagaatgcaggctttgaagtcactaacattgcctcaaatgctggttctttcacttcctagttggctctaacttcaagcaagctacttgacccttttgatccccagttttcttatctgtgaagtggagatcagaatactgcagagaggattatctggtacatagaaagcagttatcaaagagatagttcttttccccccactatgacttcctggtagtatatggaaagtcttaatattctcactggttttttctcaggcccagggttctggacttccctggctggaaggactatattgacatatctagtcttttagtctggtctaggtattttcaggactgctagaacttgcttagttcttattggttgtatttcagtctaattctagatttcaagtcattccaattaataagtgcccttcttctgagatttgtagctgcttggtgtggatctgttctgatttctgctctaaaatggaattctaggatccttgaggatgagaagttctaccatgcagacagtgacagaaccatttttctttatcagattgattattttatttagtcacaggactgcaaaagtcctctgtccataaatatttattgagcacttactctgttccagacatagttctgggagctggagatacagcaatgaataaaatcgcaaggtctttaggcacatggagatggcattctacatttcagtgaagcagagatagggggaaagtaaaacagaatatgtaagtaaacaattccacggaaaagacagtttgttcacagtgataaaatcctgtgagaagacaaaacacaatatgactgacatgtactgaggcttgtaggggcaacttgagatttgtagttagagagtcctttctgacgtagtaacatttgaatttcctgctcgttactattattcatatcttaccttcctacccctgctcacccccaaattccaatctgccaatctagcaattgtcaccatgacttggtaaaaggttgggaggcaagaattgtaggtgacagctatttggaaagagggactgttaatgcaggggtaggaatgtgcccatggctgctgacttaactgaaactagctagtctctttcagtttttgaagtgggtccacaaagcagaatctgctcctggctaggagcaagtacataggaggggttttttttttttcaattgcaaacatgagtatcaggaaaagccttctgagcttatgctggaacacaacaatataaacgacttgctagattagggtccaactagtttatcaaagcagagtaatttagacaacaatctttacggatagaggctcagagcaaaggaatcagaggggtgtgtgtgtgtgtgtgtgtgcactttcacatgagggtgagagggaaggatgccaaggaagagaaaagagtccaactagacattgtctagttgaaagatacaacattttgcaagttatatgctgtactttctggcctctgtttttttttaaatcactgaccttgaatgtttgttaataaagtgatgctaattttaaaatttgtaaaaataaattattatcataatggtacacaaatctgtaggatgaggaacttataaatgacattaatatcctataacaagataatgagtgagataaaggcagttttacatttttcagaggacaaccgaagaatgggacttttattagagtaacaaagaaaaatgaagcactgacaactgtaaatgacagaagtcaaatgtaataatagttgaatatcaaagaaaaaaatgatagcctaaaataagatatatttctgaggatagcaattaaaaatatttcctatatagcatagacaggaattccctgaactaaaggagatggaagacatgtatggttgttttaagtctgggtacactttattttcttcctctagtctgtgcgttgtaaaggcatacctgttgaaaaggaaacttttgttgggttacccctcctgtcttttaaagatgagggggaaaaagaagcctttgctgttatggatgcagttctcagaatctcactagagggtggtgttggttctaaaaccagaggtcactgctactctctacagtacattcattactaggctgcatttatgtttaaagaaaaggcaaagtcaagccttctcagtattccctagtagttgataaatgtcaaatctgaaacctcccaagtgcccctgccagttctggctggttgtagcccagaggagacagataaagtagtgaagagattatcggaggagttgggtggctgattctaattttggctcctgcactaactagtagacaagactccctgggcctttgtctcaaccgtaaaacaaaaatgatgtcctagttgatccctaaatccccatatatctctaaaattatgagattcaaaccaaattgttggtctaaaatgctgaataatttctcatgctgttagccagactaaggaacaagtaaaatctcaaattattaaattattaataagataaaatgtaatgttataagtgaggtttaatatagattctaatatcaaaggagtttaaaattaaaatgccaagtcttttgtcttaccagggagccttaggaccatggtttgcatctgagcattctgtggataatttcagtgacttaactcatcatccaaagatctctcccttcttggttgctagcttactggaaatgagcaaaatatgtttttatataggattatatagagaaaggaggctgaaccattgtcaaataggaatgttttaggatagagactaaactccccacctgcatttatctgacttggattatatctgtgctttttaagagtcagtcttcggagggatttagttggttcagtttcctttcaccctcatctctttcactgactccctttccttgttatatttactcacactgcagaatgaccttagaatcctttcctggaacctgaagcaaattatggaaccccaagatcccagtaaaccctagtttatctctgcatggacttgacttctaagaattggcctgagagcctgcaattaacctgtgaccacgcaaagcttcaccccgtcaccccaaacgcttagacattcatactcaatacccactttcctccaaattgctttgtttggcagaagaaggtttctttctcccctctccttcacccaacctggatttttgttgcatctcaggctcatttcgcaaatctaaacttcctaaaatatacacggagcgcctccgggtttgcacacgcgcgcgcgcgggtacaccctggctcgagtacattagccccgctgggccggctcccagttgcagaacacattccattcttcgcgctcgggcacacccctccgcagtgaggattggtcgggccgagccccctcggcgaggcgaggctcctaagaggcccagacgcctgccaatccccaagggctgtcaaaacaagtctccctccctgtcacaacagagctgagtggaggccgccgccgccgccgcacttcctgggaccgctgcgccgcagtccgcgggcaggtggcgggtgcgcccggccgcagtcgcccggctctggcccctatcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggtaagcaaagccgcgccgcaccgggagcgtggctgtgggtgatgggtgggtcagggacccgggcaggatgtgcggtgtccggaggcatccgggctcagcattgttttctcccacctccttcaacgccaaaccttccttccttatccggaggttcccagactcagctgtcagccacgagacgcacaagtgactttttctccccactgacggcagaggaaaagttccgctctgcgtctttgcgttctgatggatgctttccctcattttctctgcaagcttcactaaaccgttgatggagggaggaagggagaactctggataaatgcagacccaccggatggttgtgcattgctttccaatgaagggttagcttttcccatacaatgaagaaaatgcacagcttactctcaagtgtaaaaaaagaatccctctagacttaaatgatcccgaaatcccaagatgtgtgaactttcccggtagggaggcagagttttaagtggaccctgcatcacagtaaagagcaatgcaagagcccagagtttttgcgctgcagaaagcacaaccggaaagcaatcaatcccccaagcattatcactggtccttgtggttaccaccacatccagggaaaacgcttcctgacccgctaatcacctcacagaatttctctccatccatttggcaaggaatttgtaaacctctttcctcccctttctctttccatcttccttccacttggggcttgtttcttctgttcgagatttcctcttttgggagcatgactttggggtaaggttatttaggaaagaaccctcgcacaggctctggaaaagggcctcagtgtaaatgcatgtgagtaatcaatcaaatgtatgtcagattaaaattgattttggtggagcagtcagtataaaacgatatgtatgtatgtatatatgtaagtatatatgtgtgtgtgtacatacacacacacacatccctcaatgacaatgaaagatggacttttacttactattgaatttattgggttcactaatatattcaaaagctctgttcagggttaagctgcgtaaccagtgcatcacgcatgttgcaagctcccagcaccagcttaggtagactaaccacagaatgtggctccagtaaagtctttttcccaacactgacacatggaagtttaaaatcagtggagaggtttctataatatataaagaagagtgggtggtaattacaaatggcttgtagtagtttctgttattttgtggctttttgattatgtaacaggagtgttctattctgggtgtgaatttggacaaagggaaattactattttgtttttaacccacaggtcagaaagcacactgttttcaaacttaaaaaacatcacaattaggaaacacatacattttggattctactgtattgatactacatggtgtcctgtgtgtgtaaaacaggcactgcaagagactttaaaatatatgacaataaagagcaaacggctctataatgttgtaaaaaacaaaagtaatggagtataaggaatatacaaattcttgcaactgagtttgccacttgtgaattgtactatgctggtttatattctcagaagggtcattgctgagtaatggtgcctcttttgttttgaagtttctttttgtgacaaaaaaggagggagacaacagaatattaacttgatttttcccctatttaatagtaaatgcaattaacatttggtaaatggcctttaaaattaaagatattagaaaataaagtgaattattatgttaggtttttattggaaaagtagcacatacatataatttaaaaaatcaaatgttgcaaaggagtgtgaaggaaagaccctcagacactccacattcccacttatgtagtccaccctcatagatgttaacactttcttatgtatgcttccaaaatattccatgcatgtgtaagcagatatatctatatgtgtctatgatgaactatagcagctcctgatttctacaaaaaaatctggctagagttttacaagtctcatagttttaagcatttttgaagcctagagggggtaatctggtaggtctttggtgggcagcagtcattggggtctgttcccagaggccttaacgcccttctaaggagaaaaaaaggcaggtggtaagctctgttccactccgtctctgagatcaagaacctttctggtgacattcttgaatctgctgccctgtggtttgttccctttagcatagtaaaaatgagtttccaaaaaaagtttagatcatataagaaatacatagcacatgttctatattgagagaaaatgcatttttcacagttttgccaagagatttttttttaaatttggcattgaaatgtacacaaagaagaaaagctttagtacattttaatcaaaatattaaatgctgttccaaatagctgtagtgcagtaataattgatattcataatgctgagccactgaaaggttgtgaatcatcaaatattaaattcttgtcagctcaatttaaggtattgtttcagaatagtgctatcctgacagaaaacagactgtcttgtatattaataaaaagaatgtttttagtaaatttgccctccataatttgtgaaaacatgtgtttagttgaaaaaacaattttcttctgagctgaggaaaacaatgacaacatttatctgtatgcatcttcagaaattctttctactgacattgtgtttcttccccacatataaccaatcctaggtttaaaaacgttcaatgtgagaattaaactaagtttttttaaaatctgtctactttttcctatatttttctgtgtgattgtttcaacagcattgacattgataaatgctgcatgttttttggtaagcgcattgttatataccacaataatgcaatagaatccattttaatttcttcttgatgacttgtggtttgaaatgacaagttggatacctgcagtattgataatctctaaaagttgtttactattctgcatttgaatatatttctaattaagaaataagaccatttatttatctggtatttgatatcaaacttatagcatttaaaatatttaacattttagattattgcttatagccctataatctgctgccctgtggtttgttccctttagcatagtaaaaatgagtttccaaaaaaagtctagatcatataagaaatacatagcaaatgttttatattgagagaaaatgcatttttcacagttttgccaagagtttttttaaatttggcattgaaatgtacacaaagaagaaaagctttagtacattttatattaatcaaaacattaaatgctgttccaaatagctgtagtgcagtaataattgtaatgttttggaaataggaagcagcatagcttatttactatattagttggtggaaactgagctacatgtgtattttaaaaatagcagttgatttttcttccattgtatgtgacacattgacgggttctactttttttcaacttccttttgttctacttaagaacaaattctctaggcaaggaagaatagaaattgtcacttggatctcatggacatgggtgtgggggatgaagatgggagttgggaatgaggtgttgagaccagcactggagcagctacttgggtgttgttcatgtctcattattttatatcatggcgagtctcactctctcatgtcatcttgggctggtatggtggatttttgaactgaagccttaaaggtgccccttgggtaccagtagacccctatcaagattatggctttcctcagagaggcaagaggaatgcagttcacattaagtgcctactactgtgagtcatatactaaactaggagctttcgtacgtttgtatcacttaaacctcacaggaaactctctaaagtatggaaggaaggcacagagagctactgttaaaatgtggagtgatgactgaaagtcatgtctgcttaatttcagagtttgtgctcttgggctggttctcagatgcaagaagtcccacaatccatcaacacttctaggtttgaaacagcccgaacacgtgagatagtgacagaagagtacgcatcttaggtcctatggtttgtggggtacattatcttttctcagccttctttccttcagttcagaacatttggaggttgattattctagaaagggattgcaacctcttctgtctttggctattttgttaggcctgtgctgtacttgaaaagacagagcaatctggcaggtgttctgcttggcgtcaatatatggagcttacatcctattgttttaccccaggcccactttccccatacccctgcagacagtggagtttgtgaagcattgtattctcttttaggctgatacgcaggcagaaaaaatacctgggtcataggaatatatataaatctaggggagtaaggaaatgggggaatcttcttttggagctctgaaagtgtgtgtgtgtgtgtgtgtgtgtgtgtgtgtttaaatagggacggttatgaagggaaattaaatgtgattaaaaattagttaaaaattttaggcactctatggattatataggcgtttgtagattgacccaggaattaatcagcatttatagattttattctctacaaatatgtgttaaaagttccgaataaccaacttatggatggattttggagaaataaccagaggagctggccagcctttactttaccgtaagggttgctgagagtgtgccctgggggcttcagctgcggctctcctcccgagatgtgatttggctgcatgaatggcatgaacctcttaggtagatttggtttatgatccccacaacttcagttagaatgttactttctctcaaattgccatagtaacatggtcacatttcaccttagaagtggttgcttcttattgcagggtctttctgatgtgatttcttatagcacctctcaagaaaatgaagaataaacttcaggtaaagagctttgtcttactttgatgaaaggtttttgaagtgtctgttgattagtgtttgctactattatcagaatttacaaagtttgttttcccttttggaaaatatattaaggctaaaaaaagtgtaagttaattacatagccattgaggggttaaacgtgcattgtgattgagactgaatagtgttttcccaacctttccctttttacaatggagaaaacaggtaattaaattttgtacagtaaaatgtcaattgaacatttattgccaaataacacctcaggcatagcagggcattatgaaaagatatcaggagacagccgaccttaccttggtgctactgaacaagcaattcattaactgcttctaggcaatgccacagcaaactaatcaggcagtggcccaggcagtaactcaatgaaggaattgcatcagtcttctttgcgccctcactcaattctgttcagctttaataactgtgaatattaaaaataactccacattcaggagcaatgtccaaactgagatgtgcttaacactgtatattttaaaaaactatccgactttagatgaccagacagagctaagaggcaggatctcagcaacagtaaatgagccattggttataagaaggagggagagaatcattgtgttggactttacattgaaatctaaggtaataaatcaataaactttattatagtgaaacctttcagttctgcaaaatcttagtgttttaataatgtaaaagaggtttatttgtagttttgttgactcttattcacctccctatctatcctagatcatctctgtattctagttcctgtaataggaaacaatagacagagtttatggtaattaatgattatactaaactgacaataactattagggccaaacggccaacttctgtaacaacaacattcggtcttacatattggcaaatgtattgtgtatttcagctaacttttaatggcaacaaaatcatagtatgacgaagtattggaatagtccattggatttaaaattggatttcatttgtagttttatctgtaacatcttttgtgaatataagagagagatataacctagtttattttcagcagtgccgtttaaactcatcttattaataatcaatctagcattactttgagaaaagtaggattgtacatggtgagtagaaaagaagcattgtttacattatcattatcacttcagaaagaaggcaagttaattttgaaaataataaaatctatcaaggcaaaacaacataaactattttagtgtgtctcgtttccatatatttcttaatttgtatttgtaaatttatgaaagtgtgtagctattataggcaaggttattgtgtttttccttaactatacatcttcatattcaaaagtttaaaatacctttgaaagataatatctgctttattaattcttatgctgacctttttcaagagcctttaatttttaacattttttacttcttttctcttgacttttaggttcagggggtgtacatgtgtaagtttgttccttgggtaaattgcatgttgctgaggtttggtgtatgaatgatcctgtgagctagtaagcatagtacccaatagttagtttttcaacccaagtaccctaacccaaccttccccttcgagtagtccccagtatttattgttcctctctttgtgttcatgtgtatttagtgtttagctaccacttacaagtgagaacatgtggtatttggttttctatttctgcattagttcacttaggataatggcctccagctgcatccatgttgctgcaaagcacatgattttgttccttcttatggctgtgtagtattccatagtgtatgcttcccacattttctttgtccagtccaccattggtgagatgattccatgtttttgctattgtgaagagtgctgtgatgaacatacaagtgcatgtgtctttttggtagagcgctgttggatatatacccagttgtgggattggttagtcaaatggtagttctgttttagtctctttgatgaatctccacactgctttccacagtgactgaactaatttacattaccaccagcagtgtataagtgttccattttctccacaacttcaccaacatttgttgttttttgacttcttaataatagccattctggtgtgagttagtatctcattgtgattttgatttacatttttctaatgattagtaatgatgagcattttaaaatatatttgttggctgcatgcatgtctttcaaaagccttttaaagatgctaagtatgtactaaacacagactaagcccaggcaatatgtataagcaggcaaacttgtattatttacacggtacaatatcacggttagaaatggtgggattgtgatgctactgagtatttagcaatcagagatactcaaattcagaacacctgctctgtgagacattctctgatgtgagggagatggatgcacaaatgaggcaaaaagagacaaaagaacactttagtgttatctgggaccaaaattacaatgtagaaccctagaaagctagacctgaccatgttgtaggcacttttccctaaggcccaaacgacttcaaacaaaagcaagccaaataacctgtatacttaaagcccacaccccacctcccagatctgacagccgatgatgagggtgcgcacaccttctagggtgtaatcaggggcacacgcattagggctagacaataaggagtcagagacatggtcagcagggggagagtatgtttcccctctaagcctcccttggctcaggctgggttaaggcctggttcaggaaaagggtaatggcatcagaagagtgatggccctgctcccctacaggtcagccctgattgttgggttggggaggagagagagaagaccatgctatgtgcactctgacctctctctcctttgaaagcttcctccccatataacataccccatcaatgtccttgaacttgcagtttcttaatcattgatggtgactaatgtttggaagtgggagtggggatggaggtgagggagttggagcctcatgctccccctagaggcgtatataaaagatgcaaagtcatcttcagcatttagtaaactccagctttgaaatattttggaagtattgatttcatatcataattaaatattatatatttagaaatgttattaatagtaagtagctttatttttatgtttaatctaatatataaaacacctagtaacatcttgaattggttttcctactgagcaattttctttataataatagcaaatactaatataatttgtatgatgagtctagcattgttttgagcattaacgtgtgtcaaataatttaattctcacaataaccatatgatatgcatattattattatctcgatttttacagatggagagatgttaagtgacttgcctaaggtcacatagctaataaacgcagagccaagaagtaggtccaaataatctagctccagaggttgcttttaatctttatgctatatgttcttatcctctaaaacagtattgatttgaagcttagctggtgtggataaaatagcagattttttattgttatcttaaacactaagttcagctgacaaatcaaaaaccaatttttaaaacagttttgggaaactcaaggattacttgaatatacattttttctcagtttcata

SEQ ID NO: 1998 - DNA, 28068 bp, Homo sapiens
gaagtgactagcctacaactgaacttttttttagttctgtcttaaagggggaatttggtattttagcactgttttgagcactgttattaattgtgatttcctttttctgtttttcagtaagcaaatgaatcctttcattgaggatattttgaatagaatacaagatttattagagctttctccacctgtaagtatctgtctctttaagatattttacccagaattcattgaagccacacgtgccattagccttgcctttgttggcatttaaaaaaaaaaattggtggtggagggaagtgtatgtgcaaagattagttctatttaccaaaattctgttgacatagtaaacaaaacatagtaataggaatcaagagttgacagatcaatttggcagcatggggtatattgttaaaatgttgaagcattttatgaagaagaaaaaattcattaaagatgagcttgctgttaaaatgaaaagtatattaaaaattttaaaaaccaaaagaaaataaaaatttaaaaaattcaacttctaaattattctgtttaatcctataattgtattagccattcttagcagctgctactgttagatcgaaggttttccctgtcatttcaggcttagggtaaaaaaaaaaattaagtgctagtcgatctgaatattttggtgttgggattgggccataatcccaagtgttaaaatcctgaaatcctaaaaaccacaattctaaaagatcaaaatcttaaaaatataatcctggaaaaagtaattttaaaaaattatttgaaagatattactttacatttttaaaagggaatgtatttgagaaacatgtaaaaacatgacagcacttcataggccactttacacaataaaataggcaataataacatgcttttgcaagcataaacagttataaaaatgacagttacatgtgtaaaacaggagcagacaaactgtattcataaatcagaaagcaaaatgtgtaagtgcatgtcactatggttagtagttgtgtgccactctgctttataactgcgctcatctgaaataaccatgacagacaacctaagtcttgaggaaattgataaaaaacggcaatgggtcactacaacatatgcagtcacccaaagaactgagatcacaagaaattttatgtttcacagatgcagatgtacagaaaggacctttcttgtgtacatgcagtgtttacacacacagttaatgctgtgtgtaatgtacttttgcagagtcaaatttctgatgttcaaggccgcagaagaaaagtctgtccacctttcagagagagaccaatttgccttatgtatttgttctctcagagcccctggtcaattggatggtgcccgccaacactgagggcaggtcttccccacatagtctacttggactgactaatctttcctggaaacacccttacagacacatgcaaaataatgctttactgtgtgttgttacttaattatttaaaagaagtatagcactctagtacttttttttttttttttgagacagagtcttggctctgtcacccaggctggagtgcagtggcatggtcttgactcactacaactctacctctcaggttcaagcagttctcctgcctcagcctcccgcgtagctgggactacaggtgcgccaccacacccagctaatttttgtatttttagtagagacagggtttcaccacgttgaccaggctggtcacgaactcctgacctcaagtgatctgccggcctcggcctcccaaagtgctaggattacaggcatgaaccaccacatgcagcctagcctcataacaatcttatataaataagatctttacaaaagaaaacaagttagaaagctaactttaataattatcttacatgatcatttatagagtcttgtcagggctggaattagaaccgtgatctgttgacctctaatttagttttcttttcattctatggtcctgggagaaaatttgtctttataagtatttgacatatgagttggtgtgatagattacatttcctgttcctaatgcactttttctcattaaatgaagggaactcaaaaaataaaagctttaataagactgaatttcattctaggagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaaggtaagtgtgatcacagttaaaattataaagtgcatgtatctacacagacagaaccacttgtttggtgggcacacacatttgtgtttccacagttggataatccagagaattgtctaaatctttgtcctccaaatccagtcagttagatttggttgaagaaggggataggttacataccatttacatttttgccttgacaactgtaaatctttaactcctctgacttctctgatataaatgggttgtgtgtttaagaggatcagctgaagtgttaatataccaaatatatattgggacgggacatctttggttagtcttggttaccttaaagagaagagcgtgaggtttctcttcagttgtattgtgtcctgaagatcacccaagcagctgttttttccgcctctagccatactttttgttgacaaacaacagcatgaaagttgtaaagattgctaatttagaagttaaattgttctataatatatttaagaacaagagctagatattagagaggttgtataaagaattctgaagatggttttctaaatttaaatgggtggtttgcaggttacctagtacaggcctagtcataataagtggatttattttctcttttctgtccactttgtcagtaggatttttctcttttttttcttttttcttttttttgtgggggagacacagtcttgctttgtcactcaggctggagtgcagtgttgtgatctcagctcagtgcaacctccgcctcccaggctcaagcaattcttgtgcctcagcctccaagtagctgggattgcaggcatgtgctaccacacccagctaatttttctatttttagtaaagaccggttttgaccatgttgtccagactggtcttgaactcctggcctcaagtgatttgcctgccttagcctcccaaagtgctggaattagaagcatgagccacaatacccagcccagtcaataggattttaataaaacatttaggtagactcacattagaaggattatattaactacatgtcattcatttaagttaatttgagctcttttgttctggaaagatcattggaagcagtagtttacaaatagccatattagctaaagatggaagtaattgtgatgtggaaaataaaggtctggttatttagttttgttaattttgtaatttgttgtgcattgcttttgaatactccataacacttttaaagaataaagttgcatctgattgcctgatttttgcttatatagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaaggtaccgcaaactttcagagctctgaaaatctcttgaagatcagatgtatttatcttcagacatgtttcggattttgcccttgggtttctttttttttgcttttaatgaattacttaagagcctcatggatcatatgtatttttatcatctgtggtgtctggcacactgcctgatacataggtcatgcttaatagatgtttgaatataaacagaccctaaccgctttgtgtagcaaaagaaaactagtctgctgttttagaagagcatataaaaccagtaaactgagtactaaataagcaccataattcaggtacccaagcaagagttaaaagtaattcaatgtattaaagtcagttttctgtaggacatttaagctggctaataaaagtggttaatacttacatagtacctcttttttccttttttcttttttttttaaatggagatagtctcactctgtcacataggctggagtgcagtggcgcggtcacaactcactgcaacctccacctcccaggttcaagcgattcttgtgcctcagcctcctgagtagctggaactataggtgcatgcaccacaccacgctaatattttgtacttttagtagagacagcgtttccccatgttgaccaggctaatctcgaactcctgacctcaagtgatcctcctgcctcggcctccataagtgctaggattacaggcataaacctggccacttacatagtactttctatgttcaaaatctgttctaagcattttttgtacatttactcatttgatcttcatacctaccctagaagacagggattatatgttatagttgaggaaactgaggcatggagaagtgaagggatttgcccaagagttcataaaactcaggagttcatttgtaagcaagtattgagaacatgctattaaacaatgttttttacctttgttcaaaaacaagaaaaaccctaagagtttaatcatataattcattttttgagaatttaattttgaaaatattccatggcaatattgtgaaatatgtctgactattattttaacctaaatcttaagctgtaggaaagggtttaaatttaatgatcttgagtcttttagtaatattttttaaggttttttccccaccttgaaatggagtcttgctgtgttgcccaggctggagtgcagtggtatgatcttgactcactgcaacctccacctctcaggttcaagcagttcccctgcgtcagcctcctgagtagcttggactgggactacaggcgtgcgccactacacccagctaatttttgtatttttagtagagatggggtttcaccatgttgggcagactggccttgaactcctgacctcaggtgactcacccgccttagcctcccaaagtgctgggattacaggtgtgagccactgcgtctggcctagtaatgtttaggttatatagattttatcttaaaattgatatttgctaactgaattatgtacgcatgcatcctaaatagaaaagaaaggctttatgtaaaatagttttttctaagttgtatgttaatattgttactaatttctgaagtaatgattgtttatcttcagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgggaacacatgccatatctaatttgtctgcttaagtctgtgtcactgttgtacatctatatgaccaagagcaaactgaagtaaatacagaaattttgaagtttgctatcccatgggaagacagtttattgttttcagggtgggaattgatcacttttatgtaaagcacctaaaattaatttgtattctgttcctttttctttctgcaatatttttttaatttggttctttagcaatataaataacatggttacttaccagaattgacctgacaattgagtctttatggcaaatttgccattttgaaatataaaataaatggagctgtacagatttgtgtagagaattctgtataggaaatttagggaacaagataccaggggcaaactgatttttcattgttttattttttaatttgatttgatttgtgagatagggtctcactctcttgcccaggctgtagtgcagtggtgtcatcacgactcattgcaacctccacctcctgggctatcctcccatctctacctcctgagtagccaggaccattggcagttgccacaatgctgggcttattttttgtagagatgggatctcaccacgttgcccaggctggttaaactcctgggctcaagcaatcttcctcggccttacaaagggctggaattacagacaggagccaccgcgcccagctgatttttcagtgtttaatgtttaaactttaggtgcccagttaataaaaatcaagggattttggcaattctgtaaatgcttttttcccccttcatttttcccattccacctgtaaatgatttttgacttgttaatgtatatgaaaagagaacttcaggttgctttcctagttaattttggaaattgcttaaactaaaggtttttctcctcaggtgcagagaatgtagaaagagtgttggttactgttatccaaggagcagttgaatatccagatccaattgcacagaaaacatgttttatcatcctctcaaagttggtagaactctggggtaagataattttatttcttaaccttcatttcccaaactctttcataaaactcttagacataatggaacatagccctaacagagagagaaactgggagttggttttccctggtgatgaattaattgacttacttttatatataagatgaaaatttgaattctcttgacaggaggtaaagatggaccagtgggatttgctgattttgtttataagcacattgtccccgcatgtttcctagcacctttaaaacaaacctttgacctggcagatgcacaaacagtattggtaagcacctaggaatctttgtttaccttgtgtagctcatatattcccaatttcttctttaatgccaggttgattatattatgtttcattgattttttttttaacttagtgatttcagatcagggttctttttttaaagatttatgataccttctggagtttttatgaattcttattgaatcccaatgctactgctgaattttacaaattctactccttcgactttaacacctgactttttctaggaccatgaaagggcatatgtcacaaacattctttcaagcttgagtattagtttcctactactactttaattctaaaacttgtacctagtggttttccctaatcattaagagcatgaaatggcaacttgatcctccttgtatgatagtttccccaaatctaattttcacaatacttaatgtcaatttccgctttctcactttcccacaacctggtaaaagctagatttcataattgtaatttactacgttaaaacaacagtttgtatttttctgttttttttctttttttacttcaacccacttagtccatctgcctgttacctttccttcctctatcccttctctggagttaaatatttctctggaaatatttatttgaatttccctggcagtggccagggtagtaaagagaagagctggatcactaaacaagaattgaatatatagaaattcttaaacttgtttttcacaggctttatctgagtgtgcagtgacactgaaaacaattcatctcaaacgggtaagccttttagtccatgccccttcattttcatctcacatgtggtattattatcttgttcttgaaagatgtatcttgtgtaaaatttaacttttgttttgactttttggatgtggggaaaggggatgaatgaaagtagcagtatccatttattgtccttcatgttttgggtaacatgttttggtttgactaaggatgtgaaaaatcttagccagaatttcaagattcagttttcatgatcttgtaggcttcttcactaccagattttttattttatttttatttttatttatttttttgagactgagtttcacttttgttgcccaggctggagtgcagtggcatgatctcggctcacggcgacccctgcctcccagattcaagcaattctcctgcctcagcctcctgagtagctggaattacaggcacccgccaccatgcccggctgatttttatattgttagtagaaacagggtttcaccatgttggccagggtggtctcgaactcctaacctcaagtgatccgcctgccttgcttggcctcccaaagtgctgggattacaggcgtgagccactgcgcctggcctattttttatttatttacagggtctcactctgtcactcaggttggaatgcagtggtgcaatctggggtcactgcagcctccacctcctggagtctcaactgatcctcccatctcaatctccagagtagctgggaccacacagatgcatgctaccacacctggctaatttttatattttttgtagagatgggatttcaccatgttggccaggctggtattgaactcctgacctcaagttgatctgcccacgatggcatccaaaagtgctgagataataggcgtgagccactgtgcccggccttggttatttttttaatatatattttactttattttttgtggtaggttctccctgtgttacccaggctggagtgcagtggcatgatctcagctcattgcagaccccacctcccaggctcaagtactcttcccacttcagcctcctgaatagctgggagtacaggcgcacgccaccacacctggctaatttttgtggtttttatagagaccaggtctcaccattgtccctacactggtcttgaactcctgggctcaaacattcctcctgccttggcttcccaaaatgctggtattacaccatgcccagctgattctgggtatttgtaaataactggaattggttgccaacatttaaaaatctcaaatacttttttttaaccaaaaattcttccctccagcctctctcaaagccatagaatgccagcacaggactgttattgccacatagctacagccagctaaagagcagtagttgccctcaccccctaaaaagaacatgagcttttgctcagtggtctccattcagctgtgcactcatttgaacttgattttttgattctgatagagacttgaagtgttttcaattcagcagcatttcttctatacttgctacctgctagggtggggtaggtgtgtgtttagggacagcaggggaactgtataaaggtaaataaggcatcccccgatactcgagaactcagaatcaagggagaccaacacataaaaaactccagtgggttaagtactttagtggagatacataaaatattgtggaactaaagctgaatgggcaattttgcctgaggggcaatctaagcaagctataggaaagaggtgatatttttgatggcccttaaatgtagattgatgggagtaatagggagctggcattctgggcaaagttaagtaggtgtacaaagacagattagattagatgtcacatggtggatttggtgggaagttatagacttaattctgtttagctaaagtatagaggcagaagtgatagctaaaaaataagatgagactagataaaagccttgtgttacatgtgtaaagtcaggaagtcagtaggcagtgggtttgtaatttaggagggaaagtgttcggaacaatgggtctgaagcagttaggattaaatactgattttggagtcctcagtgtaagtcagtcaaagtaaagccataggaatgactgagactttctaagaccagaacagaaagaactttggctcaagcaagagtcaacagaaaggtagaagtagaaccagatagtcaggtgtggtggtgcacgcctgtaatcccaactacttggcaggctgaggcacaagaattgcttgaacccaggaagtgaggttgcagtgagctgagatcgtggcactgcactccagcctgggcaacagagcgagactctgtctcaaaaaacaaaaacaaaacaaaatgaaaaagcagaaccagaggtaggagcattatgaaagataagagaagacagtctcaagagaggagattggatggcgttgtttggatgctaaacagtcaaggtggatgtggatgaaggatgaaaggaaacagtaaggatggtatttctacttcagaagtatttgttttatccatagaagtcgtaatttaaacatacagaattgagtcaaacaatattttaaagtgttttgcttcagaaaacaaaaaaaagttttgcttcattgttcttttttctcatcttttgactgacttgaggtataagtttactttccctgattcaaaacaaacaaaactacactcttttaaagtgataacagtgaggttacaaagtgatgaacattgcataggaagcaagtacagacagggtagacataagaaaaagatgagaaggaaagtaggagggatctgggaaacagtgaagggttactgcctctcagttacagacaggtttcctctgatgggtcattaaactgggacttagatccaaggtgaaggaggaaacataaatcctttgattcagaagcactaatattaaacaggaattccaggtggtagtgcaaggaagagtacatcgaggagagatacattgatttttttttttttttttgagacagagtctcgctctgtcacccaggctggagtgcactggcataatctcggctcactgcagcctgcgcctgccagtttcaagtgattctcctacctcagcctcccgagtagctgggattacaggcatgcgccatgatgcccagctaatttttttgtatttttggtagaaacagggtttcaccatgttggccacactggtctcgaactcttgacctcaagtgatcacccatctcctcctcccaaagtgctgggattacaggcatgagccactgcacccggccaagaaccttatttttcagatggagaaactgaggcttagagaggttaagtaacttgcccaagtgcagcaaaccaccagggcacatgtatacctatgtaacaaaactgcatgttctgcacatgtaacccagaacttaaagtataattttaaagaaggtgccagagccaggcttcaaaccaaggcagtctggctctcgggtctgtgttcttaagcacaatactatattgcctttaaagtgtacatgtattgttccgattctttttaagcttattaatgtcaagcaagaaaatagttgtaagtatcttttaatcttcagggcccagaatgtgttcagtatcttcaacaagaatacctgccctccttgcaagtagctccagaaataattcaggtaagagctatttcttaccattgtgtaggcgagagatcacagtagtagcagcattgcctgtgacattgtcgctagcagaaatcaaaaatattttcatattacataagttgttgccagcatctcaaaatactgtttatgcttatcaccattttgaaattatgagttactaagtaatatcactacaccttgttacccaacaagttaataagtccttactgttctagcatactttagtttgataaccattattcagtataattggcttctatcgtaatcccatgtattatgttttatgcatttttttaaaaaaacattctaaaggagcctaataggcttttccagactgctgaaggggaccacagcagagttctgaagctttgtaccaggtagttcattgtgtgtacaccaagcttatcaatgcttaatctgtaaatctgaaactattttaaggaaagtgtctggaaagttaccttatacttttaagaagtcatttgtataatattgtttcttggcatataattttccagatttcttgtccagtagtacatggagttaatgaagtatcaaacttgattaaaactagaattacaatctcttatgtagattccaaaatttgtttcttcatcaatagtgtttttattttattgtaagaacacttacatgagatatataccatcttaacaatttttacgtgcacaacacagtattattaattatagggacagtgatgtgcctataaaatataggtggatctccagaacatattcatcttgcataactaagactttatacccactgattagcaattcccatttcccacagcccccatctcctagaaactaccattctactctctgattctgtgaatttgactactttagatacctaatataagtggaatcatgcagttatctctctttttgtgactggctgtttcacacaatgtcctttaggttcatccatgttgttacatatggcaggatttcgcaattttttaaggctgaataacatgccactgtatgtatatatcacattttctttatgcattaatccactgatagattcattggggctattttcacattgtaagtgctacagttaacatgggaatgctaatatgtctttgagatgctgattccaattcttttagataaatacccagaagtgggattgctggattatatggtagtcctatttttaattttttgaagaaacatcttactattttctatagtggctatacaccattttgcatttccatcagttgtgtagcagggttccagtttttccacaatgtcaccaacacttgctgtctttcatttttttgtaatagccattctaacaggtgtgaggtgatatctcattgtggttttgatttgcatttcccttatgattagtgatgtttgttttttcatacacctgttaaccatttgtatttggagaagtctattcaagtctttaccccattttctaatcaagttattaagttttttgctattgaattagaggagtttttttatatgttagaaattaaccccttatcagataaatggtttgcaaatattttctcccattctttagctattccagaggttgcctttctgctctgttgattgcttactttatggtgcagaagcttcttaattcaatgtagccccactaatgtagcttttcgtgatatcaatgaaatcatttcaaagaccagcatcttgaagcttttctcctatgttttcttctagttttgcagtttggagacttacatataaagtctttaatacattgagttgatttttgtgtaagataagggtctcgttttcttttgcacgtagatatccagttttaccagcaccattattggagagattattgttccccattgtgtattcttagtacccttgttgaagatcagttgactgtatacaggagttgattttcaaattctattttgttccattggtttatatgtctgtcttaaaagagagagggtctcactctgttgtccagactcaagtgcagtggcaccatcatagttcacagcaactacaaacgcctggactcaaagaatccttctgcctctgcctcccaagtagctaggatatatgtctgtcttttgctagtaccatactgttttcacactgtaatattaaaatatattttgaaatctggaagtgtggtacatccagctttgctctttctctggattgttttggctattcagggccttttgtgattccatgtaaattctagttttgttttttctatttctataaaatatgctcttggaactcttatacggattgccttgaatctgtacgtcactttgttttttatttttggaatgattaagaagctttttaaaattttttaaatttatttttattttttttgagatggagtctcgctttagtgcccaggctggagtgcagaggcacgatcttggctcattgcatgcaacctccgcctcccaggttcaagtgattctggtggctcagcttcctgagtagctgggattacaggcaggcaccaccatgcctagctaatttttgtttttgcttttttttttagtagagaccaggctggtctcaaactcctaacctcagtgatcttcccaccttggcctcctaaagtcccaggattacgggcgtgagccaccttgcctggccattaagaagcattttgttgacctgatggaacagggatattcatttagcagctcagttttatatactctttcccctgtgtcattttacataatgtgtaaagtgggggggggacccttttattgcaaagacatttccagagtcgtcatctttttctttctttttgagacagtcttgctctgtcacccaggctggagtgcaatggcacaatctctgctcactgtaacctccacctcccgggttcaagcaattctccgggttcaagcagttctccggcctcagcctcccaagtagttaggattacaggtgcccaccaccatgcctaatttttgtatttttagtagagacggggtcaccacattggccaggctggtcttgaactcctgacctcaagttatccactggcctcggcctcccaaagtgctgggattacaggcgtgagccaccacacctgtccagaaccaggggcttttctgtgaccaaggtaaccccatatcaattaccctagcccatagtgtccttggaccttactgctaggcactggctttcagtgttgctttgtacttccctgtcgtctcctaatgccattaggcctggatagggcacctgccctttaacttcacaggtagattcccatcagaactactttgaaggccaaaatgagctgggtgagagagctgctttttctcctgctctcctttcttgtgtcctcattcttccccacgatttttttgatgtgttccataatctccttattcatcttgatttctatatccaccaggacctgctcttcataatataaatagaattgtaggaagggtaatggtattgtgttcttaaacatcatgatctgcatccaagggttttttgtttgtttgagatggagtcttgctctagtcttgctctgtcacccaggctagagtgcagtggcgcgatctcggctcattgcaacctctgcctcccgggttcaagcgattctcctgcctcagcctcccgagtagctgggattacaggcacccgccactgcacctagctaatttttgtatttttagtagagacagggtttcaccatcttggccaggctagtcttgaactcctgacctcgtgatccacccacctcggcttcccaaagtgctgggattacaggcgtgagccaccgtgcccgatccaagggttttttttgtttttggatttgaggtatgttgaaaaatacaaatttcctgccactgtcacccagctccccatgtgtgttataattcactcttatgaccttcaccaagtccctgaacactactacatcaccctggtctgggtattgcagaagggtaagggccccttcataggtggtggcagtcaaacaccaaagagaggtaagagaacagcagacatcacttctcggcagattgctttgggtagcaaagacattttaacaatattaagtcttcagtccatgaacacagctttcaatggtgtttttttgttttttatttttattttgagacagggtcatccactgtcgcccaggctagtgtgcagtggtgcgatcttggctcaccgcaacctctgcctcccgggtttaagcaattcttccacctcaacctcccaagtagctgggactacaggcgcatgccaccacacctggctagtttttgtatttttggcagagatggggttccaccatgttggctaggctggtcttgaactccagacctcaagtgatccggccactttgacctcccaaagtgctgggattacaggcatgagccactgtgcccagcctcaatggtgtttttttgaagtttttataatgctgtttttttcaaaaataaagatttcacatgagtttaaaaaatgaatttaactcatttttaatgaatttgtgatctcttatttcacagtataccacctttagagatattaatgactttcttggttatcatttgatatgtaaataaactcatattttaatgaaaataataaattactattcttgtgatcttagtgctcatcaaaagtagaacttagaccattcagtttacagctaatcttccagattgctaaatgaaataaaattatttttctatttagtaattcattatgaaagataaggaacctcagttttccctttttcatatgccttatgtctgacaacacattttgcacaatattctctattagaattttcttttcttttggtctagctctgtttggttatccctcttactagatgtgagcagccgtagcaatgtagtttttgtcccattcactcctctcaggcatgaatccaccttgtctaggagagctatgttctcaaaagtgaaagcagcctgtttgacaagtactgacatttgaaaatgctataaacctcttgtggtgagatactgtttgaattaatcttgataagttaaataccatgaatttgaagcaaccttaaattcctttgacagataaatggataaacaaaatatggtatatacatacaatagaatattaagcctgatttataaaataatcctgtcatatgctataatgtggatgaacctagaggacattatgctaaatgaaataaggcagttattaaaagacaatgctctatgattccatttgtttgagatatctaaagtagactcaccaaagcagaaagtggtggttgccaggggctggagtaggggaaaatggggagttcttcagttaagaggcaaaaagcaagcttgttttgcaagatgcaaaagttctagaaacctgttgtacaacagtgtgcatgtagttaatgcttactgtactgtacatgtaaaagtggttaaggtgataagttttaagtgtttttaactacagcttttttaaaaaaagagctgggcacagtgacttatgcctgtaattccagcttcttgggaggctgaggtgggagtgtcccttgagcctaggagttggaggctacagtgagctatgatcacaccactgtactccagcctagatgacagagcaagaccatctcttaaaaaaaaaaaaaaaattaaaaaaaaaaaactggatacgaattacaatggatttaatacaaatacatttgttctttttctccctcttttccccaccccccaggagttttgtcaagcgcttcagcagcctgatgctaaagtttttaaaaattacttaaaggtaggtatttgtgaagctcacgtatcttcatacaattaggtaatgtttgagagccaagagagaatacatacctgcaattatagatgtttatgtgaagtcccttttaactaagctcttgaaaaagagtataagttaggtaagcacactgaatgtgtacacctttgagtatattggtgagaaaatgccagttttcttttacagtttcatgatgtaattaaatagaaactagagggattaggagaataagaaatgttcaagaacagttgtccaaattaagttgaaaagaaggggctaaaaatataaaaacagaaggatgagatatttgcttatatcctattttgaaacatttgaactgtaaaacagacaaaaaggagaatcctcagatttgggccatcaagcctccttttacatttacgaaattactgatttttttttttaactctgtaaatcaacaaaaagtgtcacgtgtttatttggtattcatagttataattgagttcatgagatgaaactgtcttggtcttacctaggtagtcattcatttcatacataatgactgctttttatgtaccaagtactacagtaatggctgcaaatacaactatgagtaattttccctccccataaggagctcatgatctagaaataaagttacagtgtgacaaggtgaattattttttattatcttcactcaaataatttgaagacaaagcactgtattaaattcagtagcaggtaacttagtgtatcacctggttcttttagcaaagacattcagtagaatttgtaagtcagagggctttgcgcagtaaataatttaagtgtgccatcctttgactgtggttctaacatcttcccttgtcagttttttcttagttgtagtttgtcagcttaaacatctcagagtttttgtggaagaatattgagggcttgtttttgtttatcattgggaaccctccccttcgccatcctcccataaaaaagcaaagtgcctacaggagtaacccctgttaaataactgatcagtcaaactgaatttaaggactcagtcctcactatctgttagaggtgtctgtaacagtagatctaggtaccctatagaaggcttgttctccagatgtggttatttatctgcatagcatttataaaaagtcttccttctgggcccaacttctcttcagtgatgacattatcttagtgatcataattctcagtgttagcattattattctagttggaaaaaatgaatttcattcgtgttcactcctcccttcacatctgattgatcctcagatcttgcagattctttcctcatcttctctctcttctgtctctgctgctctggtgtaggctgatgttatcttactctgatctctcttctcttgttctagccaggctgatgtgtttgaaaacttcaagcagtcctttgatatttattcaccttcctcataaccttcctgaacaaattcatgtttctcagtttggcacttaattttttttttttttcatattctgccctgagactacctttctgttttttcttgcagaaatggtctttactgttcttgtagttcttcaaaaatcctgccttactagcagcccaacttctgtatgaactgtacccatttctctaggtttgccttaagcacagcctccttgtaaggttttcttttgcctatatagtgatcattctttcccctgcacatagtagattatctattaaatgaatctcctaggtactagggcactatcaatactgttcttgtctgtattagtccattttcacgctgctgataaagacatacccgagactgggcaatttacaaaatagctttattggatttacagttccacatggcaggggaggcttcacaatcatgtcggaaggcaaggaggagcaggtcacatcttacgtggatggcagcaggcaaagagagagcttgtgcagggagactcccatttttaaaaccatcagatcttgtgagacccatttactatcaggaaaacaacatgggaaagacctgcccccatgattcaatcatctcccacccggtccttcccacaacacataggaattatgggagctacaagatgagatctgcgtggggacacagggtcaaaccatatcattgtccttactgagaacactgaattatgtctggtgctcacctgacctgccatggatggcagcatgtagtactaggccatgcctagcacagcctctagccaactcctttgtagtctcaaattttgacttggaagtacttttgaatcatcaaataaatagtaaattccttacagagttagaactgctatgtttagctttgacttgtttcctcctcaatatttaatttttttttttttgagacggagtttcactgttgttgcccaggctggagtgcagtggcacgatctcggctcaccacaacctctgcctcccaggttcaagtgattctcctgcctcagcctcccgaatagctgggattacaggcatgcaccaccacacccggctaattttttctattttgagtaaagactgggtttctccatgttggtcaggctgatctcaaactcctggcttcaggcctcggcctcccaaagtgctgggattacaggcgccgtgcccgtcctcaatatttaatttaccagtgttaatttggaaatagtaccaatcagtaaaaaggtgtcaagagcttgttttcttctgaccacttgatttctatagcatagagataacaccatattttcactacttccccagttgggtgatgtcagcataagttatatctacacttaccaaactctccagaacagaaagttcttagcttggattacatacggatatataaggcatgcgaaatgttctaatgttacagaagaacattgctagcactcagatacttggagccattcttcaggtgaaagtgatatcttctgacattagtattgattgcattaatactttatttacaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatcttccaagtcttttctggaattattataaatactttagttttattttctcatcttaatctctccataatttcccatttaaaggtttacaaatatgagtgtgtggatgctttaattcatttaacctcactcctcaaaggtaacatgcaacttagttctgttatatgagagtctttttctttaatgtactggaaaaagcctatgtgaatctgttgatagaatttaaaattccaggccgggcgtggtggctcacgactgtaatcccagaactttgggaggccaaggcaggtggatcacttgaggtcaggagttcgagactagcctggccaacatggtgaaaccccatctctactaaaaatacaacagccaggtgtgatggtgcacgctcgtaatcccggctactcaggaggctgaggcaggagaatcgcttgaacccggaaggcagaggttgcagtgagctgagattgtgccactgcacgccagcctgggcaagagagtaagactctctctcaaaaaaaaaaaaaaagaatttaaaatcccaatttattttctaactcttttattggatgtatttagaacacagtatacctatagtatacctatgtgtttattatgtttgtaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttcttttttttttttgaatagagatcagtctatcacccaggctggagtgcagtggtgacatcatagctcactgtaacttctcccatactctaccaatcctcctgcctcagcatccagactagctgtgattacaggtgtgcaccaccacacccagctacatttttttttggtagagacagggtctcactatgttacccagtctggtctcaaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttacaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaagaattcattagagtggacttttgttatctccattgtgcatttgataaaactgaggcttagagaggtaagagattagcttttaagtcagtaattggcagccgagacagcaaccctaggtctgttacattcaaaagcctctgagccactccgcatgacttcccattcattcgtgtttgctgctgctactctgggaaacaccatcttcctcttcccctccactcagaaatttagccctagattagcagcggtctctgctccctcatgttgagaaaggcctgttgtgctgtccgtgggcagaagggaccccttcagaaagctattccttattgggaatagcggcttgagattttgactgcacgaatattgcaggacctaattttagtatttaagttttagttcttaaattcttaagtttagagttagatactccaatacggccgttttccaaaataccgagagggaattaaatgaacatttttacattaagaatttaatgtatttctgggtgatgggaaaatgaaaaaaacaatgtaaagtctgaattactgcgagacgataatctggctccactgcagccaaagtgggcccttaaaacatagaatccatccctcccagctctgccggccgtctgtgcctgccccccacgtgtcccacgttctgcacacctgtaaatcttgggatgtaatcccttgctcagcgtcggtccgccctactgtcggccagcgctcggggaaggggcgggatttgcagttgcgggaatcccaattactgtgttcgctgctcagggctcctcattcccctttagagtaaagggcgagggcaacagtggacggggtgtctccagacatccccctcattaccgtggccgcggaagccgactcggcagttgccgccgcggctgtggtgactaccagacgggccataggcgtgcgcacgcgcacccgcaccggcgcgccggccgtcggtcacgtggcctccggccagggcttgcgaagccggaagtgtcctgagtctcgaggaggccgcgggagcccgccggcggtggcgcggcggagacccggctgggtaagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctggggtgtgtgtcgggtggccgtagccggtggaatggtcgcgcgggccctgttacctgcatccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaatgtattgatttttcagaggattaaaaagagacgtttccttagagttttagtgatgttcagtccgcagaggttgactcacaccggaaattagaagcataagatgttttaaatatatgccgatgaaatacgaattcccagacatttccttgctcctcgtctacctggcttatgggtttaatttgtaatctctatcccaagtattcttagtaggtggcctcaaaacaactcccaagtaattgccaaatgtataaccaaagactggtcttttccactctgaaaccccagtgtatgaatcacataggggcagagtttagaaatcctggaactttgtccataggccatgtcgtcaaacctgttttcatccctcaacaaatagtaactttcgttttggacggtgtaaggaagtaggctgaagacggcatcatcagcaacatagttgttgagtgtctgcttatatgcttgtcaaaaatttgggaagatttatatggcaagcacgttgtgggtgtgctgagtcatgttttaacatgttattgtggagttattggaagataatttcaaaagacatttcccctgaccactattgtgattactgttaaatagaaaccatagttttgtatttgcatagagaacagatatcttagctgataaatatttttcttattatcctgaaggtacatacatataggtacctaatggtactatttgccatttacagttacattgattagggaaggtttttcgttagatagttgagacgtttgttattgtatcgtgagtgaaatgtaatgactggcaaatgtgtattccttatttgtgaaaagggaatcttatttttattgcttatttcctatagtcgtatataaagtttatctaaattagatgggtagtaaaattatataaaaatatcctactatatcagtgattggtaaaattgagacccctgaccattctgcattttcctaacccagcttggggatattggtggtcattaattcatcacagaatacctagtctagcatactactttttgctttaacttactgtggagggatattaaaatccatgttttaatgacaatacagcaggtttaagggggcatggtgggactagtgtttatgttatgttagcatacatcaattttagtccagtgtggagcttggatactttgtataccttgatagatccatagcttttcagtattaaagacttgataatacaggctacttggtacgtttatatatttatacttggaggttggagaaactatccttaaattaattccagaagagttcgtaacttttcaggaataataatttttgcacctttcctttatgtttgtcaggttctgtgtagattgtgtagataaaattttagcttatgggaatattatgcagtgacaacatttgtcttcattagtgtttctctgctctgaaggaaacaaagtaatttttcctatatttgttatattttacattattacttttctttattttaaaacaccttaaattatgtcataaattaatctttcaaaacatttgaaggaggtaagtaacaatatcactctcatcaacaaagacaaaattagaagagaaataggtgttgtttttgtttgtttttgtttctttttgagatggagtctcgctctgtcaccctggctggagtgcagtggtgcgatctcagctcactgcaacctctgcctcctggtttcaagcaattcttctgcctcagcctcccgagtagctgggattacaggcatgcgccaccacgcctggctaatttttttgtatttttagtagaggcggggtttctccatattggccaggctggtctcgaactcctgaccttgtgatccgcccgcctcggcctcccagagtgctgggattacaggcatgggccactgcacccggctgagaaatagatgtttctttcagccctgtgttaagtgaattaaattgaatgtatgtcattggttaatgttttttttttcaaagctcatacagcattttagccttgaatattgctagaaactcagatcttttttttttttttttttttttgagacggagtctcgctgtgtcacccagcctggagtgcagtggcgcgatctcggctcactgcaagctccgcctcccgggttcccgccattctcctgcgtcagcctcccgagtagctgggtctacaggcgcccgccaccatgcccggctaatttttttgtatttttagtagagacggggtttcaccatgttatccaggatggtctcaatctcctgacctcgtgatccgcccgcctcggcctcccaaagtgctgggattacaggcgtgagccaccgcgcccggccaattttttttttttcttttttttttttttgcgatggagtcttgctctgtcacccaggctggaatagggtggcacgatttcagctcactgcagcctctgcttccgggttgaagttattctcctgttgcagcctcccgagtagctgggatacaggcacctgccaccatacctggctaatttttgtattttttgtggagacggggttttgccgtgttagccaaggtggtctcaaactcctggcttcaggtgatctgcctgcctcggcctccaaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaactttgaagaccttttatcactgtatgta

SEQ ID NO: 1999 - DNA, 503332 bp, Homo sapiens
aagaaacatatagccctatttctagcatcatgtggtagaaacatacagtcccttaccattatatccagggacaaccctaaagatatttataaaaaagaaatcaaggtcctattatttttaactgatcttatctggataataatagattaagaaaacaaagataaagaaagtaaataattgcacacagtttattgcctctgtatcagataaatgatctgttcctatcttgctgtataatgcaacgataagtgaaacttaaaaacttcaaacaagcatttgaaagcatttaattccagatatcttctgataaaataatgactaaaggtgttggaaagaataccaaactagaaatcaagagaatgagtttccagtcctgtgtaggcctccaaggtttaagtactcagattatatatctgtaaaataagaggtctagacaagatgatatatggtataccttccagctttaaaattttaccaaactaagtactcaattatatcaaaagaacagcattcatagattttaaggtaaattgaaaatattaatttattggataacatcatagctttattgtttgtgatcacacattaactgaaaaagcttttgtctgattgctgcaataatatataggaaaagcctcttagtaatattagacaacaataacgataaagcatttcctctgaattcaccatttggaaatacttttcttattctttgacaaatagggatgactttccaagttagactgaacttgacctttgggcttcaaaaataaagctactttacatgtgaaagctcatttttatatgatggtgatatcatctgaatgtttgtgcccctcaaattcatatgttgaaacttaatcatcgatgtgatgatggggcctttgggaggtgattaggtcatgaaggcaggaatggaattaaagcccttacaaaagaaaccccagagagcttccctgccctttccacttgtgaagacacagcatgatgatgtcatctatgaaccaggaaatgagccctcatcagacatcaaatctgccagtcccttgagcttggacttcccagtctccagaaatgtgagaaataaacttcagtcatttataagtcactcggtctatggtattttgttacagcagcccaaacagactaagacaattggtatgaattaaaccttttcttactgcgaatcacaattcacatactttattataagaaataatcggtattacattgaaaaagtttctaaaataacatctttttattggctattccctaaaaataaatcaagagaattctgcagacctttatacattggactacagatttgttaagagaagaaaaaatcatagtgtattttcattttctttcttgggagggataatctgctcactataaaaagaaaattatgaatcactgatttagattagggttctcaaaacgtattccccagacctgcagcagcaacatcacctggaaacttgttagaaatgtaaattcttgggccctattccaaatcaagtgcatcataaattctggggatggcccagtaatctgtgttttagcaagtctttcagcaattctgatgtacctaacgtttagttaatactttattttactggtctactttataagacatatatacttatttctgcacatatcaagtagtaactgaatgggtaagaaagataatttaaaatataaagtcgaatcttagaatgttactggccaaacttacgaaattaacctactcttgctttctgagttattagctttacttatcttgcttagtttcccacatgtcacactgaaatgctcactagctccagatttggtcaatttaacatctactttgtcattttttttcaacaatcttatgctcaaactgcaactaggagtatagtatataatttttaggtttccttacaatctcttaaagattagccaaattttaaaatagaaaaatatgcaaactttaaaaattgaatctgttcatccaacaacaatcatcagttacctattatcaaatctcttacaggctaaggagagaataatgaataaaagaaatttaaaaaaaaaaaccactctcagagagcttccattttttgggatgttacattgtatttggtttggtattccttttcaaaaaaaagggtacctctaacatttgtacaagttactcttctgtttttctacttttatgttgctaataaatagtaccaaggtgcatgcagatatataatattaaaataataatttgtgcatgaattatttcagaaaagtataatgaattattttaaattctcttaatgaactgtaagctgtaagcaaatgtaaaattactagtaatagacacagacaatatttttaaatgagaataaatccaagtatttgtaaataacatcctactcatgatttacagatacagtttcattagttataaaacattttagaaatatataaacaggaccggcgtggtggctcacgcctgtaatcccaacctaggtgggtggatcacctgaggtcaggagtttgagaccagcctggccaacatggtgaaaccccatctctactaaaaatagaaaaattagctgggcgtggtggagcacgcctgtagtcccagctactcaggaggctgaggcaggagaatcacttgaacccaggaggcagaggttgtagtgagccaagatcgcaccactgcactgcaccctggatgactagagcgaaactccgtctaaaaaaaaaaaaaaaaaaaaaaaattccatatttataaatacagacatacactacataataacatttcagtcaatgacgtactgcatatatgacagtggtcccatatgataatggagctgaaaaattcctattgccttcttacattatagctgtcataatgtcacagcacaattaatttttaaataaatttagtgtagcctgggctgggggtggtggctcacacttgtaaatcccagcactctgggaggctgaggtgggcggatcgcttgagtccaggagttcgagacaagcctagacaacatggtgaaaccctgtctctactaaaaatacaaaaattaaccaggcatggtgatgcatgcctgtagtcccagctacttgggaggctgaggcaggaggatagcttgagccctggaagtcgaggctgcagtgagctgagatcatgccactgcactccagcctagatgacaaagtgagaccctgcctttacaataatctcctgtatcttatgagatattctgtttcttaaacatctcatttagatgctttaattttattcaaccaaggttttagaactcattagctctaaaacaatcatacagacctcagttgggttttctctcagcattgatgttcatttactgttactattaatcatctgatacattatagacatgcctgtgtatctgtctagatatatttaggaatataggtatctaccatttacttaatgcttgctatgtgtcaggaaggtgttaaccattttatactatacatatatgtgtgtgcacatatacacacacacatacacatatattcataactaccccatttagtatttatcatgccttagtttccttaactataaactaaaataactgttatttttaagttacacagtttagcagaatagagatgtaagcaagtctgcttttctcccacgtctatgctcttcttaatcactagacttacattataagccctcatggaaccatgggaacacaaacctgcttggttcactgcttgtcactttccttaaaattatgccaaaaaaaaagggtcttaaagacttggcatttctttattaataatgaagacacctgaagaagatcaacaaagtacttttcttcatactaatttctcactcacaatttgttgaggccaccaaacaagcaagctacatgggaaattgaaattagaccaaggtggcagcatacatgtaccacatacacatatatgtatatattaacatacatacatatgtacacattaacatttctgtccatttggttactgaagttggtatttagggtgcaggaaattactaaaatgatagaagaaagttactgtggaaaggctgtgaagaggccaagtgcagtggctcatgcctgtaatctcagcactttgggaggtcaaggagggaggatcacctgagcccaggagtttgagaccaacctgggcaacaaagtgagacccctatctctacaaaaaaattaaaaaaatcagctaggtgtggtggtgtgcatctgcagtcccagctactcaggaggctgaggtaggaggactgcttgaacccaggaggtcaaggctgcagtgagccgtgatgatgttgctactgcactccagcctgggttacagagtgagattctgtctcaaaaagaaaaaaaaaaaaaaaaggctgtgaagaaatcttgagtactaaaattaaatgagaaagaggatagccagatatcagtaattaactgcttattttactaaaataccgaggcttatctaattccaaagtcaatccaaatattctaggagaagttcgcgtacatgcatatgagcatttggtttatggggaagaagataaggatataataagagaaaggataatgaagaagcatagtagaaaacatccctggctgggcgcggtggctcacgcctgtaatcccagcactttcggaggccgaggtgggtggatcacctgaggtcaggagttcgagaccagcctggccaacgtggtgaagccctgtctctactaataatacaaaaaaaattagccggcatggtggcgcacacctgtaatcccagctactcgggaagctgaggcaggagaatcacttgaacctgggaggcggaggttgcagtgagctgagatcgcaccactgaactccagcctgggtgacaagggtgaaactccatctcaaaaaaaaaaaaaaaaaaagaaagaaaaagaaaagagaaatatccctgcgttagcacgttagcatataattctaattgtgatacataaggaaatgtagacagttgattaggggactctaaaacttatcaaaaagcattttcaatggctaaatagaaagtagcaaatagaatcttcagaaacaaatggaaaactctgagcttaaggataaatgagtaaaggggaatcacttccagaacagtgaagcagtgaaatgggctcctccaacaatgcaagaacactgggattaactgtcaaaatcaactttatcagaactctgaaaactaactaaaggcttgcaataatctcaggagtgtgattttaagaataacagccaaataacagtaaaaacagcaagctttgtggaattttaattttctctattcttatcatccccttgccaactccgtggtatccttacaagtcaacaatctcacaactatggctgctgtgaaaactagcagcctagcagttactagacagggcagaatgggtctggagcacctctaaaacccaatcgcaaagaaatgtcactttatgacctgtgtagcagctccctgaaaagctccattcccagagctcatctttccttttttttttttttttgagacccagagtctcactctgttgcccagactggagcgcagtggtgcaatctcggctcactgcaacctctgcctaccgggttcaagtgatcctcctgcctcagcctcccaagtagctgggattacagatgcccaccaccatgtcccagggctcatctttttaagatgtgactcacagcatgctgtgaatgattatatccctagggcatttgtcaaaagcaattaatggtaactgtttaacactgcacctgccttaggtggtgatatgagttaggactagagaaattaatttccagtttgccacattatataatctcaaatatcctcttatcaaaaaattacgaaacatgcaaggaaagaggaaagtatgtctccatatggaggcaaaatagttaacagaattgcttctgagaaagcccagatgttggacttactagacaaatattttaaatactattataagtatgttcaaagacctaaaggaaaccttgtctaaagaattaagagaaagtatacatgtacctcaccaaacaaacaaacaaaaaatcaatatagagatataattttaaaaaacaagtgaaattctgcagttgaaaagaacaatattcactagagggactcaatagtaggtataaactggcagaagaatcagtaaacttgaagataagtaaattgagatgatttagtctgaggaacagaaggaaaatagaatgaacaaaaatgaacagagcctcagagaattataggatgccatcaaatgtaccaacatatgcataacaggactcccagaagaagagtcagagaaaggggaaaaatgaccccaaacttcccaaagttgatggaaaacattaatctgcacattgacaagctaaatcaactccaagtagaatagattaaaaaagatccatatctagacaaatcatggtcaaatgactgaaggccaaagataggatctcaaaagcaacaagaataaaaaactcatcacacagaagtgattctcaataagattaacagtagatatctcataaaaaaatgtgaaggccagaagttagcgggatgatgcttttgatattgtgttgaaagcagactcaaccaagagttcaaaccatccagcaaaacactcctttaaaaaaagaaaaaaggaaggggccaggtgccgtggctcacgcctgtaatcccagaactttgggaggctgaggcgggtggatcatgaggtcaggagttcaagaccagcctgaccaacacggtgaaaccctgtatctactaaaaatacaaaaaaattagctgggcgtggtggcacatgcctgtaatctcagctactgaggaggctgaggcaggcgaattgcctgaacctgggaggtggaggttgcggtaagctgagatcgcaccgtgcactccatcctgggcgacagagcgagactctgtctcaaaaaacaaaaaccaaaacaaaaacaaacaaaaaaaaaaggaaggataagcagtgtcctgggttactgaaaaaataaattaaaaaaaggtgaaataaatacattgcaagataactgataattcagagagtttgttgcttgtggacctgcccttcaagaaaaacagaagtccttcggactgaaatgaaagagcactgacagtaactaaaatccatttaaagaaataaagaacactgataaaggtaactacacaaaatataaaaaccagtacatatatatacatacatacatatatatatatatatatatatatatatatatatatatgtttttgtttgtaattcttttctctccatctaattaaaaaaaactttgtaaagaaatagttataaaaataagttggtgggcttaaaatgtataaagatgtaatttgtataaaaccagcacaaaggaggcagaagggaaatgaactatcttggagcaaagtttttatatactactgaaattaacttggtattaatccaaactagattgttttgagatgttaattgtaattctaagggcaaacactgaaaaaactcaagaaaatatactaaagggaaaagaaaattaaaattatatagtaaaaaaatactaatttaatgcccaaaagtgagtaacggtgaaacaaaggaaaaacaacaacgataatatatcagacatataaaactccaaaaccaaattgtagacatcatcctatcttatcagtaatttcactaagtgtaaatagattaaacactccaaataaaaagcagagattatcagaatggataaaataaataatccaattacaagctatgtacaagaacacttcagatttaaggatacaagactgttgaaaaatggaaaaagacataccatgcaaatggaaatcaaaagagaactggagtggctattctaatatcaggcaaaatagactttaagacaaaaactcactcactagagacaaagaaggacattgtataataataaaagggtcaaccaatcaggaagacttaaaaagtataaacatataagtacatgatacagtctcaaaataaagatcaacataaaaatagaagatttaatcaatgctgtaatagatgtctataggatgcttcacttaacaaaagcagaatacatattcttgtccacagaacattctctaggagacaatatgttaggcccccaaataaaacttatttaaataaataaattttaaaaacctgaaagcacagaaagtatgttctccaaccatgataaactgaaaaagaaatcattcacagaaaatttcataatgtatggaacgtaaacaacatactccaaataaccactgggtccaaaaataaaaccccagggaaattacaagagaataaatgaaaagaaaaacacgataccaatatgtatggggtgtagaaaaagcagtaatttgatgaaattttatagctgtaaatgtttttattaagagaaaaagatatcaagtgaatatttttactctgtaccttaaaattgttaaataaaaattaaacccaaaggaagcagagggaaaaaaatttagagtggaaataaataaaacaacaaatagaaaaagagtagagaaaattagtgaaataaaaattggttcttcgaaagatcaagaaaattgacagagcttcaaatagactggccagggtagaaaaaacaaaaggtaagatccaaattaataaaatcaggaatgaaagaagaagtatcattaactactttagggaaatgaaatggattataaggaaatgaactatcaattgtatgttaacaaatcaaatagcttatatgaaagggacaaaaaaatcctagaaagatgcaacttaaaactgactgaagaagagagaaaatgtgaataggccaataaagagattaaaccagcaatcaaaacactgcccagaatgcatcattggtgaattgtaccaaatgtttaaacaaataccaatccttcacaaacttccctaaaataagatagaaatgaacattttctaattcattccatgggatcggtattaccatgatcccaaaaccagacaagaaaattacagatcaatgtcccttatgaatactgatgcaaaaccctcaaaaatataccaataaacagaatcaacatatgaaaaagattatattatacatcataacaagtgggatttgtcaagggaatgacaggttggcttaacatatgaaaatctaccaatgtaacagaccatattaatagtattaaaggtaagatccacagaacaaactcagtagatatggaaaatcatttaataaaatttaacatcatttcctaagaaaaacactcaacaaaagtaagaacacaaggaaatgtcctcaacctgataatatataataacctgatatatagcctataaaggctatatataggctacacacacacacatacataacagcatagctaatttcataattaatggtaaaagactgacagtttaccttctaagattaggaaaaagacagggacattcataccacttcaacattgtactggaggttctaactggaaaaattaggcaagaaaaaaaaaaggcacccggatcggaaaggagaagtaaaactatctctattagtagagtatgcagacaatctcaaagaactgatccccccaacaaaatctgaaaaaaaacaaaccccagaaaaacctgttagaatatacagattcaaaaaggtctcaggatacatgagcaatatacaaaaaaccacttgtctttctatacccaagcaacaaacatctttacctgagtaatgaacaatctgaacataacaccaattccatttgcaatggcatacaaataaatttaacaaaaaaaatgctgaaaaccacaaaacaccattgaaaaaatttaaacagacctaaataaatggacccatgctaaaagactgggaagacttaatgttttcacaatttaatctatgaattcaatgcaattcccataaaaaattttgcaaaggctgagaaggtgatcataagattcctatggaaatgcaagggatctaaaataaccaaaacaatctcgaaaaagaacaaggttgaaggacacaccctgattttaaaacttctacagatacagtaattaaaaccgtgtaatgctgaccatagaataggcgtgtgtatggatcaatgcaaaaaaattcagactctaaatataaactcttacatttttggtcacctgattttcaacaagggtgccaagaccattaaaaggaaaaaaaaaaaacaccaaaaaacaaactaacaaaaaacccccacttttttcaacaacagctaaatgcgaaagaataaagttggatccttaactcacaccatctacaaaaataaagtcaaactggattacagaccttaaaggtaacagctaaatatataaagccctcataagaaaatctgagagtcaatcttcagatcaggcaatggtttcttagatataacatcataggtataagtgacaaaataaaaaagtaaactaaactttatcaaaatctaaaaaattttgtgtgtcaaaggatatgatcaagaaagagaaaagacaacctacagaatggaagaaaatatttgcaaatcatatacagtcaaccttcggtacccttggaggattggttccaggattccccttggacaacaaaatctgtggatgttcaagtcccttatataaaatagtatttgcatacaacttacacaatcctcccatacactttaatctccagatttataatacctaatacaatgtaaatgctatacaaatagttgttatactatttttattttcaaattgttattttttttcaaatgttttccatttgtagttggctgaatctgtgaatgcagaacctacagacacggagggctaaatgtatctagtaagagacgtgtatccagactatacaaataactcttacaagtcaataataaacaggttaacttaattagctacaaataatataaatatatttacattaaaaatttatatatattttacaaaattttacaatttatttttatatactatataggtatatttatatactatatgcctggtacatattaagtactcaataagagttaggtataattattattaaattcctaagttatttgactattaacaaggaatgatgttttctgcagaatgcctatagctatgtgaccatattttccaaaccaaatatagatttgttaacttcaaaccctccctccctcccttcctccctcccttcctttcttccttccttcttccctccctctctcttccttcctttccttttctttctttttctttctctctctttctttccttttctttctttcccttcctttctcctttcctttctctctctctctctttctttttagaattacaggagaatccataaagtgaaagcaagtttattaggaaagtaaaggaataaagaatggctactccacaggcagagcaagcctacttcaactccatttctgaaaaccaaaaattatttctcagtttattgaaataagctctgattcacacacacacacacacacacacacacacagtatattaaaaaaatctagtatacataattatataacaaaacataattataatctccccaattagaaaatgagcaaagaatttgaattagacatttctccaaagaaaacatacaaatgtcatttcagaagatgctcacattatcgtcactgggaaatgcaaatgaaaatcatgaggtgtcacttcctatccactaggacagctataatacaaaatcagtaacaagttacgatgtggggacactgcaacactcattcatgtctggtgtgatcgtaaagtggttcagttgctttggaaaacattttgacagttcctcagaaggttaaacagagttaccatatgatgcggcaattctactcctaaatatatacacccaagagaatggaaaacttacgtccatgcaaaaacctgtacatgaatgctcacagagtaatattcatggtagctaaaaatggaaacaacccaaatgtccatcagtgaattaatggataaaaaatgtagcatatccatatacttgataatatttttggtcatcaaaaggaatgaaattctgatacatgccacaacatggatgaaccttgaaaacattacggtaagtgaaaaaagacagacacaaaaggctacacagtgcgtttatataaaatatccagaataggcaaacccatagagatggaaagttgattagtagttgttaggggtgaagaaatggaaaggatcattgctaatgagtacgggatttcttctgggggggcaacgaatgttttaaaattagatagaggtgatggctgcaaaactataaatatattaaaacccactgaatggtacactttaaaagggtgcattttatgccatgtgaattatatccaaataaagctgttataaaaaaagaacatcatggaaatgattgttaaaggaagtgtagttggttatgatgaagaaagaaacagtgcaagaaaaaatacacgtaaggagaccatatttctccatgtcagagaagacaaccttgattctggccatggaaatggacaaaagaggtgagactgtggaaatataatcaaaggagaaagcaacatctgtgggatataagagaactagctaagcttaacatattacaccaaagtattgctcataagaccaaacagctggtagtaccaatgacagaaaactaaagtggaaaggcccagtgaaggtcctggggaagacaggagttttactgagctgtgcttatttttatttttatttatttatttattttttgagacggagtctcactttgttgcccaggctggagtgcagtggcgcgatcttggctcactgcaagctccacctcccgggttcacgccattttcctgcctcaccctcccgagtagctgggactacaggtgctcgccaccatgcccggctaattttttttatttttatttttagtagagacggggtctcagtgtgttagccaggctggtctcgatctcctgacctcgtgatctgcccacctcggcatcccaaagtgctgggattacaggcgtgagccatcatgcctggccaagctgtgcttatttttaggttctttaaattaccaagtggtaacagtctaagtatggattataaagattttttttctagtaaaagagaaagaaaagaattaagattagaatatgagctggacagtcattcatgcttgaacatgagctgaaacttaagtgtatacagtgagcttaccaagtaggtctcaaggaagagatgaagcagccccatcacctcattcttgggggatacaaacaatcacctcctcattccttcactccttttcttcaagcagctgtctgtggcatgtgggtagcctagtttgaagtatagcaggtgtttgtaatttcctttctcaaggtcacaggtgactctgccagtgcacttcaaaaaccacagcttctgggcccctttcttcccaccaaaccccaagatccccttctcacatccagattactctgttacttacacatctttaacccactccacagctattagaattgaagtgcccctcttcccaggaaattgactaaggttctatccactagcctcagatcgttatctgtttgaaacttctttgtgggctgatggaatgttttccaagaaatgttttagaaattggctttcttagataatttccatggtggatttattaagaaggaggaaatcaaggtcatctgttctttttagctgccattctggtcagcctttccagtggtgcctgttgtctccaaccttcattatcacattccctgcctaatcccattgaaagttacagttatattacaaagatcagatgagataatatatagtatgtagcagggcttttaaaaatatacattgtttcatacatgttaactgctgttaatactacctaaactgctctcaattttcacaaaatttgccttgtgccactgaatgacattagagtttaatggtttattcagataaactgattctgcttttagagagttaatatttttggctcatttatcataatgaattaacatattaaatctaaatggttctagaagacgcttgaagaccttttttctgttttccctttggcaaacggtgatgataataataatttatctcatagaattattatgacattcaagtgagattatctgctttgcacagtgcatagtaggtgcccaataaatgttaggtacaattattattcaattcctgaagttcttcaaattatcatagaggaaaggtgttttgtagcgaaatatttctgtagaacacccacagctataaatgtgatcatattttctaaatcaaatgcagatcgactaactggaattcctctgctgaaaaccaggatttattttcagatttggtaaaataagctctgaagccaaaaagtactcccagagaagtctgcatatgttgccataagatagtgccagccagagagattctgacaagaaaactttatgaagtttgatttaaactacagaataagaagggttttttccccctctacggatttattttacttaatctttatgcatctagctaatctgtgacccaattatgtagttataccaagggtgtctgtgttagtgacggccgtgtggctatctctgtcaaagactaatctcactgctggggacactgagatgacaggatagagtatcacaagaagatgaaacttggtgaactcacatgtttatcacggtaaaaaaacaatctatggaacattagtagtggcagatggtagatgtccatctaggcaggaaaaccagggtactagcagtttgataacctttgattaaatttctccccaaatggaaagtaatgctccataataatgtgtgttaaattttttcttttccaaataattgtttccttcatttcatagcctgttaactcaaggtttgcttcctgctagtgactatattactgcttccttagagtggttaaattttattttccttttggtaaaggaaaattttaagtaaccactatatcttattttaaaggcatgcagtaaatgctttgttaaagcacaataaacactgaaattactattaagtagtaacactcctcatgcaaaattacttaaaaataaaaacttaaattgcctgcaggaaaaaaaattgttgccattttgattttgtgcactgtttaacatttttctcatgtttttgaataaagaaaacttgtatgaggcattataaaactcgttaatgctacaaagtttggaaggcagctattaacacagttgaaaaaatcaagattcaaaagaattttgacaagcagggtagcgagtcaaaaatgaatctatgaaattcagtaaaaagaaatggacaacattgcagttagggttaaatagtaatagctaatggccgagagattactgtgtgttagacacagtatttagtacttgaaacaatagaataatattaataaggcagacactattatcatcttctttccagatataaggatggtatgaggcacaaatatataaataatgagaagacttgtctcaacaacatatctttaaaacatcaaggagttatgttcaataacaaacaaaatatccagataatagaaaccaataatacctagtcttgaactcctgggctcaagtgatccttctgcctcagcctccagagtggctgggacaacaggtgcgtggcactgcacctagctaatttaaaaaaaatgtttttaagagatgggttcttgctatgttgtccaggccagtcttgaactcttggcctcaagcgatcctcccgcctcagcctctcaaagtgctggcaggcatgcgccaccacacctgccccttttcttatattagaaaaaatagtgagaatttatgaaatgaagaaaaaagattactgggtgttcattcaatagaacactaggcagcctgaccagtgccctccctctttcacgctatatactacacgtgttctccaacccatctgctggctaaattgcacagatatctggatcccacatcccactgcttagcattgtttatcaagcactgagtttatgaaggtggagagactgggccctatagtgaagagacttagattctgatctactgacaacaactaacctatgcccacttattaagcggcatgaagttttcaacaaaaatggtggtgggtgttaactgccacattataacataaggaagtgaattctaactgaatcctaagaataaataaaatgataagtgagcattcaaaggatcaccactagagatgtgcttcatttttctgctctaatatattgtctttgagcaataagagcagctgaaaaagatgcatagaactttagacccaaaagttgactttaagatcaattttttcaacttttgtcattctagcaattagaaaagtaagtcccttggcaagagaccttgccacaactgacctactctactcctttgtcaaatgctaaaacccagtttgcatctttctcctgcctcattcatattgctggatctttccttccatctgagaaatatttattttgaatggaatactgttgtataattacccaaactgtacttttcactttcacagaacaaggaaaaagaaatctttatttcacattctatataggtttatctcatggcagtccttttggcaaaatgctttcttttctgaaataagtcagtaacatatccacagggctaaattaattgctattctattttccatctcctctcatgacaagcctcttcaattgcttctgattcatcatgcctcctagtgtgaccatccagcttcctttctgggccctgttctcattctcccagagacagcataaaaacacactccatttccatacttgcattggtttccgagatgctacattatccctgatctcctgcctccctttctaccatttgtcttctttgagggctcttcttccagctttcaaaatatgaacatacatctaggccggctctctgttcttacttattcttacagtttcatcatatatacatttattcatttaagcagtatctactgaaggcctataagtagtggtgagtaagatggacatagtccatgctgttatggaacttacatccagttaaggaagaccagataagaaaataaataaaaaattccaaattgggataactgctaaggaaaaaaaagaaagtgtaataataaagactaatgggggtgaaggaaggtcttttgaaaagttaacatttacctgggatctcaagaaaaggcctattatgcaaaaggttgtgtatattcaggggcagagagatcaaatgttcgaaggtctttgggtgagtgggagaaaggttggttgtgttcaagaaactcagaacagagagtaccataggatgatgctgaagagacagacagacagcagatcatgcaaagccctataggccctaggaaagggtttgggttttatcctaaacataaggagaagttactgagggtgtaaagcaggaggttatcccattctgacttatagatcactttggctatcatgacttacagaactgatgaataaggtgatcatatatttagggttgcccgagatagtcccagttcatgcctattgtcctggcataactgaacttctgcattgatttcagggaagagtcacaatatgcaataaacaaatacatacataaataaaacaaaaaacaaaaaaaacaaaaaaaaaaaaagaaagaaaattgactaagacacaaacaagctgtgggaggcaacattcatcaggtttccttgttcctgatctccttgacctaactgggatccttccttgggtgctccctttgattcttgaactagttttacttctcaagcttgaaatatgttcttgtccttaatatctggctatctcctgtaattaaataatattcagcagctggtatacacaaatatatcgagtgaggtcctatttgcataaactcattcctcataacattccatgaagtaggtattatccccatttacagatgagcaaactgaagcacagagaggtaaagaaacgtgactaaagacaaacacagccaaagaatcaggacttgacaccaggtaatttggttctggaatcagtgttctttacttctaacattgcttctcaatgtgagaaaccgtaggcatatttaggaactgcaaatagctcagagcggccagagtgagtactgggacaaactggaggtaagtttagaaaagtagcagaagggtttcaaatgacatgcaaaacaactaagttttcatctgacaggtgatggggtacaccacaggatcttaaatacatgatcatatttgtgctttggataaacagctctgtggaataggtggaatagaaggtgggtaggaggagaatggttcctgactcagctttttctaaagactggacctgcgcctccttcctggatggggcctttggatatccattgtgaagaacctgcatgcaattataatacatgacttcccacaacctaggcctgggccttccaatgatgggatctccctttttaactacaacttttcctttgagtccctttcatcagctctcatctccaagtctttttataagcatacctctatttccacactgatcccgatagtctccttatttaaatccttatcaccacaaatgtagatttctgtagcttcacagctcagttaccttcttcctaacgccaccacctgcaatttcatgagctgcttttattttaatccttttaaaacattactcccttcatcatattattctcatgatcaaataccttactattgcttatacagatagtcttaactgttaacctaacattcaatgatctttataaatgatgcccaaatcacattttccaatcttctactatctcatctacgctgctgcagtcaaattttctacccatctataaactgtgtgtacacagtgtgtctttctataatctttggtcacactgttactctggtctagcaaaacgcattcttttaaaaatcccatcctttcatgatctggtttagcacttgccgactctaaacagccttcctaaaccactccagtgctgggaattcctacagcactcaaagccttacaccatattcctatatttgggcacaaactgcctcagtaacatgacatcccttccgttattgctctgaattttttattcatttcatatattaggatttagctgtttacaggtcacttttctaatgacatcaagaactactcaaagacacattgtgtgtgtatatatatatacacacacacacacacacacacacaatatatatacacacacatatatatatgtgtgtgtatacatatatctaaagacctataaaaccatgttttgtgggttttttttttttttggtatttctacttttcccatagtatttccatacctcaccagtgctaggtatggtactatcctatgtatattgtatacctcatgtttcttgataatttagaaaattcaatttatgctgctgttatatcttccagtaatataaaattttcagaattttaagagtttttcaggtagaaaaatttagcaaaaccaaaagagaaatggaggaaaaaaagtctaagaaaaacataaatgccagtggagtatgctaatgggaaaaaaatcaacataagcttcacaatttacaatgtctggagaaataaactgatgtgcttatacttaaacatgttatattacggaagactacaagtggttgttaaagagaacctattttgcatttatatttgaatttcgatagaactgctttgaattgctactttattgataagggaaaacaagttcttttatgacaagttataaaagcttatagtttatcagttccctctccaccctgcaattacctacaggaagagattggccatgggttctattttatgagttttataggggcccattcaccccagtttacatactatgaattcttggaaaatgcaatagattgtagaaaataaagtgcttcctttgaataaaggacatttcacttaaactcatacatgtatctacatacaagctgtcccaaatattatgttaaaatatgaaacagccatattttacatgaatatatgtataaagtatacaaaagtataatactgcaataggtagcaatcttgtcaatctacagaattggctaaacaatgataacaatctaacaacaataacaacccaacagctattgagtaagtacagatattatataatccaagagattcaggataaaatttaatttatatgattcagatcagtacatttatgaataagtttagtgttaatggcaaacaatattacaaacatctcagaaatatttcagaataacaaaataagactaacgcatattaaagtttactactgatgaaataccatgtgacaaaaattcattcagcccttagaaaactttgaagaaaggtaactgcagaaggaataaattaatagcttttaaaattggtcttataaatatgaagaataatgaatcaacatttaaatttccaatcaggttagaatgctttaaattctaataattaaaggaatacttaagacacatggcaagcgtttcatagttggtataatcctgatgagacagtctgaattttatttcaacctgttgtgatagatgtgtaggcctctgtgaaaatgcaagctgtaattttatatactgcccaaaatccatttgctaaaagaagctttgttctctctaccggggttacagggtcactgaataaaaactaaaaatattaatattagtgttacaagtttggaatgtaggagctttacaaaaatttaagttattcattcgaataggccatattgatgtcatttgaattttatcatattagttttcactggaagagattcaaaaacagtactcaagacactagaaattatatattcagtatggcttatcatgtttcaatgtattttacatgtatattaattctgccagaaaatatgaaaagctatgggatttgccaagcatatgactgtacactgaaaggtagatatgttttaactatgttccagggggaatacttccttatgctagttgccatttccctttgatttgcaaataagtccttcatttaaagtaaatacaggactcaaacttgtgctgacttaacaattaactaacttttacacctgccttttagggttcagacaataacctctgattaatctgggctgatattatccttaacttactataggcgataagcaagtgcagagggactaattcttaaagtggcatgatgtaagtcttttcatataatctaacatcatgattatctcatgtcttatttactttttctattatcaatagtacagtgtctgaatgaatatcattcaggacaaaaattagtgaaaagaaagccacacatttaaccatcaaatctgacctaggacattaggtataaagaaaataaaacaatatctataatatacgagcaggccacataggttccttacacaagagaatgactagcagtctgatgtccaatgtctcttctgcaatactaaacgccagaatgcaaagataatcaacttccacaatgttttgaggagaaaaggttaagttcaagtaattaaaaatcttggcaagctgtctaatagtaaaggcaattgacaagtatttaaaaatatgcagactcagataattcacttcccattttctaattcttgaagaacaactagaaaatgtactctgaggtataaacaaaatgaagagctcagcatgccaaaaaaattaagtgattatagacagttaaaaatagaggtttgattctttttgacgaaaggggtgtcacatcatgtggagatttttttcactttctattaaaggtatctcaaaaaaacaaatatggtactatttgtaagaaagaaaaaaaaaacccaaacaaaaaaatcaaagttcatgtagtaaatgaaaaacaaaaaggaaacaagtgaattaaaaagagagtgagaggtgacatggaacaaagggacagaggtggttttgttctcaggctgatctttatttactgaagggacactggattgtattatagtactatagaatcaaactcaagtttgattgaccataaccatatatttactgaaaacttcacttagaattccaacttggaatgttaagaaacatatcggctgggcgcggtggctcatgcctgtaatcccagcactttgggaggctgaggtgggcagatcacgaggtcaggagtttgaggccagcctgacctacacggtgaaaccccatctctactaaaaatacaaaaattagctgggcgtggttgtggacgcctgtaatcccagctacttaggaggctgaggcaggagaactgcttgaacccgggagacggacattgcagtgaactgagattgcgccacggcactccagcctgggcaacagagcgagactctgtctcaaaaaaacaaacaaacaaacaaacaaacatatctttcccttgaaaagaggtctgataaattctcatttgctcacttccctcacccatttaatggctgcaactagcatataccactctcctagaactgccattcatggcagtacttggagcaaggggaacgtgggcatgaaaatgggtaaagaagtaagctgggaattgagggttaggtctggggtcgagaagtcactcagggtcccagcctcagctattctaaaatcctggcccactccctttctgtttttttctcaggctctaacagatacttaaatcatggtatctcttctttttttgggtcagtagaatacaaaatttggggctacaaatattccactttgataatttttagactcctttttttcctccctaaacattttcttctcctaagccctttaaagaaaataagagaagataggttcaaggatggaaattagataaaattacatttctgtgaaaatcagactttacttgtcctggtctgggaccagagggcactgggcaataataatgaacagacttatgattctatttagaggttatggagaaagggcaaagattaagtgttggaaagccaggggctgttggggagagaggtagtaacatccttactttgtagtagagacacagaaggagaagagtagccaatccttcctcagaaaaatacatcaaaaaggactgaatatattattcaaatacattaaaataataaatttttcttaattgccattctttaattttttaatactaaagaataaaatttatatcatgttatggctactcttttagcatacttactaaaggataactgaaacatacatactacagtcaagttctttttaatgattatgctaattcctcatgtactggtcttttctaaagtcccacatattaagttatcaaacatgttaaatcaatcatagggatttattacaaataaaaaatagagtcaatttgctactgaggcatatattaatcatcaacacaattcaaatactttaatattacctttatttatttatttttgagatggagtcttgctctgatgccaggctgaagtgcagtggtgcaatctcggctcacagcaaccttcacctcctgggttcaagcgattcccctgcctcagcctcccgagtagctgggactacaggcatgcaccaccatgcccagataactttttgtattttagtagagatggggtttcaccatgttggccaggatggtctcaatctcctgaccttgtgatctgcccgccttggcctcccaaagtgctgggattacaggcgtgagccactgtgtccggccatctttattttcttaattggtacagtttgactatccctaatccaaaaacctgaaatatgaaatcctccaaaatctgaaactttatgaacattgacatgactttcaaagaaaatgttcattgggacattttggatttctaatttttggctcagggatgcaggaagtgtaacacaaatgttccaaaatttgaaaaagaccaaaatccaaaacacttctggtcctaagcattttggataagggatactcaacctatattaccaaatctttctcacaataggaaatggagaatcacaggaagtacttggaagacttatgaatgcaaaggataagaaataagagtaggattagggaatgtacagtgtactctatatcatcttatgagtctttcaattgcaaactagcaactaatatatgtttcacacaaatatcatattcagagactaaaagggaaatctaataattatcttccttctattaatacaactttttaaatatagtgaatagatgctataattgttaaatgccttttgttgagaagaaggataaaagataagacttcagttctataataataaagcaaagtaacctataagagaaatgaagcataatggccttttttcactattataaaacattcactttaaataatgatgctagtgcacaaaataacattcatttttagaagggtaaaaatcaatttgcacaaatacttacattacattatcaaaactataaattatttctaagttaacaacattaatatgaacaaatcttgcagggatataacttttggcaaaaaggttttaagagttttctacaatggcactgtaactataaccagtataattttgtactttcttaacacttttaacaacgtagcaacagactgtcttaccgttggtgctgtatctacctgatggttacaaggctttctttctatgctgataatccctgtggaaagaaaacattgtgagtatttggttattaagcctgtccattttatgttgaaaatattcatgccattttattggaaaaacatttattatgactcacacagcttccaagaaaaaagtctcacttggaaggcaagatccttttaagatgtatcatgaattctttggtcagaaacagttggtctaaactgactcaaggttagctaagccttttttcccattcaagtgatgtctagcaatagcgcaagatgtgtccacatcctgctctcaactcaaaaattacaccattatctgggctctgctgcttttcttccatgaaagttttatttctgattcaaggatatgaagtttttaaaaagaagtatcacaagggctatgaagtgaatcactactgtcttattttctcaaaagaataaataaatccatctgaatttctctttgatcatctgacttcctactatgacatactctatttattcaatcaccatgagtatctgaagaaaaatgttcccctgattccctcctttaaaatgataacacagatggctaatcttgagaaatattcttttatcatgtgtggatttatctttttgttcccaatgttctctactgcatttctttgtaataaacaccctttcaggacgtgacacaggggatctcatctgtaaagatactggttcaaagtctaactcaagttaaaaatgaacacaagtgtgggtcttgtttaattcctaatttctggccaccagcaaactaacatataatttaggatattaacatagtttgttcaaacaatgctaaaggctgtcatatgcaggacaagaggcaagaactacaatgtctgttaatagcaattagtaaaattcctagtttaaatgttagtttctcttctacaagcatatgactcatttttcttaaagtacggtaaaggattaagtgagatcaacacaaacaatcactttttatcgctttgcaagagtattttcaaaatgaatcatgaaacatgcagtttttgtttcattaattttttgtaacatttattgttagccagtgaagtataaagcactatactaccttcattcaattgactaatatttttgagtggttattcttggtactcagtgataaaagatgaatatattacagtttctgactataagagtctagtaaaacatggatatccttttctgaagaattaccacagagcaaatgaacagagtttcatcttaagtgtaataaaatctttaaggtaattttgatggaaagacactcttattcatagagtaacaccagttttgggttaattttttttcaaagggtacaacatgcaggcaaataagtaatgtagattcctattgtaagattttaacaatatagaaatatagagagaataaattgagaaatcccaactttgtcagcccctacagtctcacaatcctagctgcaaacactgagaatagtgtggcatggcaactggctttcaaatgagagtggtcatgccagagttcagcaattaacaacatcttacacacgtcttctcactattgtaatctgactgttataaaattgacctaggctgattactgatttttaaattcttatctaaacagaaagtaattttaattggagaaaaggaactttaaaataataaaaaccaaagcaaaccaggcaaaaatctatatatacagtttatacaataccaagaaaaaaacaaaaaaaactctacagattttagtgtttccattttaggataagaatgtgttgaaaattagaatttcaaaaactggattatccaaagttataatcttagttttaaatttagattacatatataaataatatttggaaatacaatcatgcatgtttgttcaagcttgcagtaaaaaatatatagaaaggaataaactttagaaaaaaatgtatcaaaataacttcctattttaggtaaattttacttaaaaatctgtatttgtatctcatttcacttttattaatgtataacaataattgaaagctcataataagtagcatgctataatggttagtattatatgtctacttagctaggccatggtacccagatacttgatcaaacattattctagatatttctttgaaggttttagatggaattaacatttaaatcaacaggctttgagtaaagcacactgccctccatgatgttaagtgggcctcatccaatcagatgaaggccttaagaaaatgacaactcacctgagagcgaggggattctgccaacaggctgccttcagactggaactgcaactctttcctacgtctccctcctgttggcctagcctgcagattttggtcttgccagcccccacaatgtttgagacaattccttaaagtaaatctttctctctctatggtcttcctactggttctgtttctctggagaaccctgactagtaatatacttactttctgggacatatgaaataaataaaaatgctattgcttatactctaaattataaatgttatgttcattcaacataattgtgtaggaatatagttaaaatgttgatgttagtatgaaatattttaaaatctgcatatatccgaatgaactcaggaatatatagatagaataaatcgacctatcaacaaataaaaatgaaaaaaattataaaagcagtctgtcagcagaataaagaatcaatctatcaataaatattactgctaggttgtccagtctaacaatctctgcctttcaatgatttgactatttacatttaatgcaattactcatatggctttgctgaagtttagcattttgctatcttattgcatttctttttgttcttttcttcctctttttctatattcttttgcaatagtcaaatagttttactcttccattttatgtcctctgatggctttttagttacatctcttcatattttttaatggctaatgtagagattacaacgtaccactgtactataccttgaattaggatttcttctacttcaagaataatataagcaacttaaaacagtgttaaccccatttattcaaccaccctttatgcttttgctgccttatatttaacttctatatgttataaacaccacaatatattgtcagtattgttgttttaaactgatatatttatctttatcccttcttgcagatccaggctttcacatgagatcattaatcccctgttattttgtagtgtaagtctgctggtgactatgttttttcctgaaaaatctttagtagggattcatttacaaagaatgttttgctgggtattgaaatctaggttaatagccattttcttttagaaaatgatttcattccattatttcttatgagaaggaagtcatcattcttactatgatttccctgaacgtaacacttttcccctctggctgcttttgtaattttctttttagtttaatcaggaggtacctaggtatggtttcacacacacacacacacacacacacacacacacacacacacacacacacgtgtgtatatttatactctaaaggaatataaatttttcattttcttcagtttaattaggaggtatctatggtttcatttatatatatgtatacgtgtatgtgtgtatctttggattttgctaagcttttaaattttattttttttgattttattttttatttcaataggtctttgaggaacaagtggtgtttggttacatgggtaagttctttagtggtgatttatgagattttgtgtatctgtcacccaagcagtgtacactgtacccaatgtgtactcttctatccctcacccctgtcccaccctttccaagtccccaaagtccttagaataagagtctccaattctatccaggttgctgtgaatgccattattccattcctttttatgactaagtagtattccatggtgtgtgtgtgtaggtgtgagtgtgtgtatatatatatatgtataaagaaaatgtggtgtatatacacatatatatacttggtgattgatgggcatttgggatggttccgtatttttgcaattgcaaattgtgctgctatatataaacatgtgtgtgcaagtatcttttttgtacagtgacttttttttccctctgggtagatggtagcgggattgctggagcaaaagcgctacttttcttaggttggtgcaaaagtaattgcagattttgctaattgaaactaatggcaaaaactgcagtaacttttgcaccaacctaatagttctttaaggaatctccacactgttttccatagtggttgtactagttcatgttcccaccggcaatgcagggatgttcccttttcaccacatttacaccaacatctattattttttgattatggccattattgcaggagtaaggtggcatcacattgcagttttgatttgcagttccctgatcattagtgatgctgagcattttttcatatgcttgttggccatttgtatatcttcttttgacaactgtcaattgtctatgcatgtccttagcccactttgtgatgggattttttttttcttgctgatttgtttgagttccttgtagattctgtatagtagtcctttgtcagatgcatactttgagaagattttctcccactctgtgggttctctgtttactctgctgattcttttgctgtgcagaagccttttagtttaagttccatctatttatctttgtttttgttgcaattgcttttgggttcttgatcataaagtctttgcctaagccaatgtctagtagtgtttttccaatattatcttccagaatttttatgattctgggtcttagatttaagtctttcatccatcttttttttaaattttattttattttattattattattattattatttttattgatcattcttgggtgtttctcgcagagggggatttggcagggtcacaggacaatagtggagggaaggtcagtagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctccaatgtctacctctttctacacagacacggcaaccatccgatttctcaatcttttccccacctttcccccctttctattctacaaaaccgccattgtcatcatggcctgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctcccggacggggcggctggccgggcagaggcgcccctcacttcccggacggggcagctggccgggcgggggttgacccccccacctccctccgggacggggtggtggccgggcagaggggctcctcacttcccagtaggcgcggccgggcagaggcgcccctcaccccccggacggggcggctggccggacggggggctgaccccccccacctccctcccggatggggcggctggccgggcggggggctgacccccccacctccctcccggacggggcggctggccgggcagaggggctcctcacttcccagtaggggcggccgggcagaggcgcccctcacctcccggacagggcggctggccgggcggggggctgacccccccacctccctcccggacgaggtggctgccgggcggagatgctcctcacttcccagacagggtggctgctgggcggaggggctcctcacttctcagacagggcggttgccaggcagagggtctcctcacttctcagacggggcgtccgggcagagacgctcctcacatcctggacggggcggcagggcagaggtgctccccacatctcagacgatgggcggccgggcagagacgctcctcacttcccagatgtgatggcggccgggaagaggcgctcctcacttcctagatgggatggcagccgggcagagacgctcctcactttccagactgggcagccaggcagaggggctcctcacatcccagacgatgggcggccaggcggagacgctcctcacttcccagacggggtggcggccgggcagaggctgcaatctcagcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaatccccgtctccaccaaaaaaatacgaaaaccagtcaggcgtggcggcgcacgcctgcaatcgcaggcactcggcaagctgaggcaggagaatcaggcagggaggttgcagtaggccgagatggcagcagtaccgtccagcttcggcttggcatcagagggagaccgtggaaagagagggagagggagaccgtggggagaggaagaggaagagggagagggagagggagagggagagggagtgggagcgggagcgtctttcatccatcttgagttgatttttgtataaagtgagagatgaggatccagtttcattcttctacatgtggcttgccaattatcccagcaccatttgttgaacagggtgtcctttcctcactctatgttttgtttgctttgtcgaagatcagttggctgttaagtatgtgggtttatttctgggttctctattctgtttcattggtctaagatcagtactatgctctttcgatgactatagctttataatatagtttgaagttgggtaatgtgatgcctccatatttgttctttttgcttagtcttgctttcgctacatgggctctttctttggttccatattaattttaggattgttttctagttctgcgaaaaatgatggtggtattttgatggaaattgcattgaattttttattgcttttggcagtacggtcattttcacaatattggttttacccatccatgagcatgggatgtgtttccatctttttttggtgtcatctgtgatttctttcagcactgttttttacttttccttgtagagatctttcacctccttggttaggtacattcctaagtattttattttatgttttgcagctactgtaaagggggttcagttcttggtttgattctcagcttggtcactgttgctatttagcagtgctactgatttgtgtacattgattttgcatccagaaactctactgaattaatttatcagatctaggagctttttggatgagtctttagcgttttctaggtatacaatcatatcattggcaaacagtgacagtttgacttctttactgatttgaatgtcctttatttctttcccttgtgtgattgctatggctaggacttccagtattatgttgaacagaagtggtgaaagtgggcatccttgtcttgttccagttctcagggggagttctttcaacttttccctgttcagtataatgttggctgtgggtttgtcacagatggctcttattaccttaaggtatgtcccttctacatcaattttgctgagggttttaatcataaaggacgctggattttgtcaaatgctttttctcttgagatgaccacatgacttttatttttaattctgtttaagttgtgtatcacacttattgacttgcatatgttaaaccatccctgcttgatcatggtacattatctttttgatatgctactggatttggttagctagtattttgttgaggatttttgcatttatgttaatcagggatattggtctgcagttttcttttttttttgttacgtcctttcctggctttggtattacggtgatacgggattcatagaatgatttaggaaagattcccttgttctctatcttttggaatagtgtcaggaggattggtaacaattcttctttgaatgtctgatagaattcagctgtgaatccatctagtcctggacttatttttgatggcaaattttttattaccatttcaatctttgtgcttgttattggtctgttcagagtttctatttttatgctgttttatccagaaggatagtatatttccagcaatttatctatctcctctaggttttctgatttgtatgcataaaggctttcacagtagtcttgaacaatcttttgtatttctgtggtttggttgtaatatcccccatttcatttctaattgagcttatttggatcttctctcttcttttcttggttaatctcactaatggtctatcgattttgttaatcttttcaaagaaccagcttttcatttcattcatcttttgtatttttttgttgtttcatttaggtctgctctgatctttgttattttttctcttctgctgggtttgggtttggtttgttcttgtttctctagttccttgaggtgtgaccttagtttgtctgcctgtgctctttcagatgattgtaggcatttacggctatgaactttcctcttagcactgcttttgctgtatcccagcagttttgacaagttgcatcactattatcatccagttcaaagaatttttaaatttccatcttgatttcattgttgacccaatgatcatttgggatcagtttatttaacttccatgtatttacatggttttgagggttccttttggagttccttcatttatgaagcttagttcctctggatacaaaattcttggctgatgattgttttgtttaaggcggctaaagataggaccccaatcccttctagcttctaggatttctgctaagaaatctgctgttaatctgacagattttcctttataggttacctgatgcttttgcctcacagctcttaagattctttccttcatcttgactttagataacctgatgatgtgactaggtgatgatctttttgtgatgaatttcccaggtgttctttgagcttcttatatttggatgtctgtatctctagcaagaccagggacgtttccctagattattccctcaagtatgttttccaaacttttggatttctcttcttccaggaacaccaattattcttagatttggtcatttaacataataccaaacttctgagaggctttgttcattaaaaaaattttttctttgtctttgtcggcttgggtcaattagaaagccttgtctttcagctcttatgttctttcttttacttgtttgagtctattggtaagactttccagtgtattttgcatttccctaaatgtgtccttcatttccagaagttgtgattgttttttttcatgctgcttctctggagatttttccatccatatcctgtatcatttaaaaaatttctttaagttggtattcacctttctctggtgcctccttgagtagctaaataattgaccttcagaattctttttctggcaattcagagatttcttcttggtttggatccattgctggtgagctagtgtgatcttttgggggtgttaaagaaccttgttttgtcatattaccagaattgtttttctggctccttctcatttgggtagattatgtcagaggggaagatctgtggctcaaggactattgttcagattcttctgtcccacgggatgcccctgatgtggtgctctccccattcccctaaggatggggcttcctgagagctgtgatcgttgtttttcttctgggcccagccacccagcagagccaccaggctccgtgttggtactggggagtttctgcagagtctggtgatgtgatccgtcttcaggtctctcagccatggataccagcccctgcgctggtggaggtagcaggggagtgaagtggattctgtgatggtccttggttgtagttttgtttagtgtgctggttttgtgttggttggtttccagccagaaggtggtgctttcaagagaacataagctgtggtagaatagggagggtacaagcttgccctagggtcacctggataagtattcaggtttcttaggtggtgggcagggccacagagctcccaagagattatatcctttgtcttaaggtaccaggacaggtagagaaagaccatggtggtggtggggggcacccgcaggattaggtatgtctgaactcagactctctttgggcggggcttgctgcaactgctgtgtgggatgggaatgtggttctcaggctgatggagttactttcccaggaggattatggctgccactgctgtgtcatataggtcaccagggaagtgaaggaaaggcagtagttacaggcctcacccagttcccatgcatcccaaaatgccactctcgttcccactctacccctcagtagcaaagagtttatttccaggcagccagtgagcagggttgagaacttgccccaggctacaagcctcccttctgagaaagcaagcagggcttttaggttttgcaccttcccacctgctgtggattctgtgctcatatctgcactcctcatttgctccctcctttggattctgtccaggaaactttgccttcagttgaaattgttacagacttcagctagaagtttccttctccttgttgtctttcttcaattccactggcagccctccccaaggactcctgcaagacagtcaggaatgcaggaatggcttccctgaggaccaagagtgcccacagggctcttcccactgcttcctctacccctatatttcactcggctctctaaatttgtctcagctccaggtaaggtcaaatccttttctggtgatctggaccttcaggttccccagtgaggatgtgtgttcaggggtggacattccctctctcactctttgggcactaagtttttcagctgtctcacagagcatgtagcagcaagctgccccctctaacaggtctgtggattctcttggcttttctggtagtagttcttggagcaaaagttcacagtgtgattctctgtgcactgctctgtccgtccaagtgggagctgcaagttagtcctgcctcctatctgccattttgagacagcatcaacacagttatggaaacaagctttaaatgctgatgactgcttctccttgctaagctttttatgtctataggttgtctttaattagaggaaaactactagcccattatttcttcaaatatttcttcacccatattttctgttttccttctgcaattccagttgcatgtttaatccatttcacagggacacacagatatgactctttcttcttcccatgcctcctcttcatctttgtttcaatttgaataatctgtataatttttattgttttgccctccagttcagtggtcctttcttttaaggtgtcctatctgttgttatctgctgttatctgttgttaggtccatctaatgaattttcattttatctgttataatcttcaggtctagactataattcatttattttttaggatttccatttaagagaaatggaaatcctgacttccatgaaattctccatctttgcactccttttgctcatggttcctcataagttatttaacatatgtgtaacagatattttaaaattcttgcctgctaatgccaacattttgattatctgtaggattccttttattcattgttctttttctttgttatgggtcatctatttctgctaattcacatgcctcagaatttgattataggttagaactgccagacatgtaatcagtagactgaaatagcaaacgtcttccctcagaaaaggctcaccatttcctttttcagaaagctagggtgaggggtagatctcttttcaaatcaggagctgacttgggttgggactgggctgttgcttagttaatttcaatacacctattataactctccccaaaatgagatgagttattccttctagggggactttgggatttaaacttctagagattatgggaactctctctgccttactcccagtttcctgtcagtgcttaagcttcaaaagtcctcttggggagaactgataggcggagaggactgagtgacatttgggatctttcagattccaatctatcatgccagtccacatagtccttagaagttcagctaatctctccttgcctcagcagtagctctgattatagaaggcttgctcctctgtttgcctggtttctatctcaataaatgttcccatgtatttaagtgactgtttgtctttacttctttatgcagtagggttcatttctctttgcaatttattttgtttagaattctctgtgaccacatctctttgatggctttttagtttatgtgaggtcttctcaataatatggtaagagtgatgatcattacaatgtacatattaattagaagcaaaactctacttccaattatttatatggttgctttttaaaattttcttgttttcggtctatttcagtggatactccttttttttcttgcctgttgatcttgaattcttgttttcaattttaccaacacttaaaatctgctattagttcccttctggattctaacagtaataaatacatttattatttatccaaataaatttatgtctaaacctctctccaaccaagatactatacataccaatatctccttgctccacatcaagattaaacttttagaaggcttttatttctctattctttttatatagttaagtttaaagagataaaaatgcatgggaatttgtagaagtgctaagtgtgaatttatgaaacaaaatgatatagtgtaagaaaacacctaattttttcctctatgcctaacagaaaaatctaatgttttcctctgtcttgagatttctgtttcattgaattgtcatttggttacagtactctctaaatccttgtatatccaaatatgccttcctttggataagaaaccctttatcttggttgcctatatgttattccactatcagccagcttctagtgttttagatatgtcaggtgctcatgtgattttctttcctatgtaaagaacctgttcctcctctatagaagcttgtgatatttttcctttacctaggaaatcaggaatttcactagagtacggctgagtgcctttgttatcattaatcttttcccgggacttgataaaccctttgacctgcagagtcttatcattcttctgctcagggaaattttattctattatttaattttatagctcatctttaccttcacaacttttatcttcatgataatcttttcaactaatcttctatgtgaacatcctttctactctagagattttaacatttgaagtcatatagtttagtttctttcgaaagatctacaaagactaagacaagaaggctagcaaaccctggagtatatatcagaatgaagttttcctgggatctcagtgccaatatgtcaaggcaaagggttggggtgggaggactttgttctactcggtgttgagcaaggatctgtgcagggtaagcaggctttttccaaaggtgtgagtagaaaattaagttttcagagttcattgagggctttcagccagcagaagctataaatccccttggaaatgggcaatatctgtaagtttaatgtttgtagtacaataagggcctagcagatcctatgaatcataataaccctaaaaagggtctatacacctggaagaaatggtttctggaagaactggcattcagtcccagtcattgggagatggctgtaacttgcaactgatgagacttgagaagagagccttactcctgtgccccagcagaggggtatcagttgggcaggtttgattttgctacaactcagacttccatcagtatagctggggcaatagaccatgaagaggcaaagaaaataattttcttcaagagcctcagtagcctgaagaagaagaaataaactagaactggtagtgatactgatgacaatagaagaattagagagtcttttaaattaaaccaaaacaaacaaaaaacaactattaagatttcttgccaggtgcagtggctcatgtctgtaattccagcacttggggaggctgaggcagaattgtttaagcccgggagtctgagactagccctggcaacatagcgagaccctgtctctaccggaaaaaaaaagaaaaaaaaaaaagaaaaaaaaaattagctggatgtgggtgtgcatgtgtagtccagctacttgggaggatggcttgagttgagcctgggaggtcaaggcttcagtgagctatggttgcaccactgcactccagcccaggtgacagggtgagactttgtcaaatacacacaaaagtttaagttaattactaaacaacaagataaccctattttaaaggaaggaaacagtggctttcagaaagtaaattagaaggtaggtaacattcctaaggtcatataactaaaagcagcagtacctggactgacacccacacctctaagccacaaacccttcagacccatttatgtgtttgtttagcccctgtggttgggacctgatttttttcatcttcatatccacagtgcctaacccaaatgcttaaaatacagaaggtcttcaagaattgactcaaatattaactgaatgaatctattctcctatgccacattcaccagattcatatgctacaatgcagtgttaggtgtattagtcatcagaatgcctgagttaacgtactaggactgttttaaaaaacgttaatttaccctttggtaatgttcctaaacttagtgcaaaactgaaatgttttacagtcatgtgctgagtaatgatgttttagtcaatgacagatcgcatatacaatgagggtctcataagattataatactgcattttgctgtaccttttctatgtttagatacacaatttttaccattgtattacaactgcctatggcattaggtatggtcacatgctgtacaggtttgtagtgtaggaacagttggccataccatatagcttaggtgtagtaggctatactatctaggtttgtgtaagtacactctatgatatttgcataatgaaaaaaatcacctaactatgcatttcttaaaatgtatcgccactgttaagcaatgcgtgactatacttaaacatttccctaatttcccagatactaatacagtctagagaagataataaaagaaattttatgtttcttgggagacacttttagtatttattttgtagaaaatcagatcatgacattttattccattgtacctaatctgaacagctgaaagcatacattttttagttttcctaaaccctaccaacctttaactcaggactacgatcaaagaaagaagaacaaagacaaacagataggctgcaaaacaaaaacagacaggaacatgtgccaagttttgaagacagaacatatgtccagcaatcttatgtatcattaccaagtggttacaagctacttgctaagcacaaggcactgttctgggaacaggagaagctctaacctccctttcatgacatcttaagagttacttgtttcgggcaatatgatacctatgcatcctatgtcagttttggcaatccccggggatctttctatatagaacagagatagaattatggtttgattatctgtgcctatgaaaacatgagatttattacattccagtagaatacagttactgaaggcagagatcttttctgctagtttatatatacatatatatatatatatatatatatatatttttttttttttttttttttttgagatggagtcttgctctgttgcctaggctggagtgcagtggcgcaatctcggcttactgcaagctccacctccaggttcacgccattctcctgcctcagcctcccgagtagctgggactacaggtgcccgccatcacgcctggctaattttttgtatttttagtagagacggggtctcagtgtgttagccaggctggtctcgatctcctgacctcgtgatccacccgcctcagcctcccaaagtgctgggattacaggcgtgagccaccgcgctcggcccttttctgctagtttaatgtgaagaagttatctgtactgagactgcaagcctttcttaagaactggaaaagaaggtaaactatgttttgcagataatataattttatatctagtaagtccaaaagaatcaatgctaaaattaacacaatcagtaccagaactaataaactggaaagtcagcatcatataaaatttaatatacaaacgtcaatttctcttacatattcaaacaaattagaagatacaatgaaagagaatatttcacttataagggcaatataaataataatatgaataaatacaacaaaaaatgtgtaaaacagtatgaagaacaccttaaaatacttctgaaaaacacaaaagtccaggtggcccttgacttatgaaggtctgacttaacaatttttcaactttaccatactttgaaagtaacatgctttcagtggaaagcatactttgagtacccatacaactactcagtttttcactttcagtggaatattcaataaactacatgagatattcaacacttaattataaaataggctttgtcttagatgatgtggcccaactgtatgctaatgtaagtgttctgagcatgtttaaggcaggctaggctaaagtatgatgtttggtaggtttggatgcttttctgacatattatgggtttactgggctataactctattgtaagtcgaggagtatctagttggaacatcccatgttgtgtgacaagacaatgtagcatcatataaatgtgagctctccccaagacaatatataaatttaatatgattttaatttttaaaaagtttttttttccagcactagacaagttgattctgaaaatcatatagaagaacatgtaagaataccttaaaaaaatcccgaggggaaaaaaacgagcaaccactggaaataaacactactcaatattagtatatatcataaaaagcctctgtaactaaaataatgcaatattaacacgagtagccatgtagatgaacagaatagattaaaatgtttagaaaaagattcaagtacatacggtttatgaagaagaagagatgttttcatatacatggtgttgggacaatatgttggggacaagtggatggacattttgaaaaataaattgaatccatactttgcaacatttgtactgcaaagtcaaaagccaaatgacaaaatgggaaaaatatttgtagcctttattattgataaatgacaaggctccctattatgtcaaacgaaagcatacaaatatacaataaagacaactgggaatatcaatataaacttgattttgtaaaaatatattttcaagttatgttcactgaaaggatctagaaggaatgattccccaatagcaatgagtgtacttagtcccagattttagtttctaaattgcattacctactaatagtatcagagttctttggagaaatgactgattccagctctggggtagggatagtaccagatgaacttaggacattataagcacagaagtgctcaaaggctaactggttcatatcaaaggacataagagcaggaatgaatgggctctcctttgccaaattggggacaatttgagccacactcaaaaaatgttagaaaagtagtacaacaaattgaatgaaaaaaacccatagtactcatatagaaagaaagacaggaatggggggcggggcggggcgcagtggtgggggcaaagaaaacactctactgaagaataaggtgataacagcactagaaaacaccattttgtatcctcagcccactacaataattatttcaggctaggatcatcaatggacactgaaatcactaagtagggttactaagcccactaagtaaggaacacacacaaagaacaaaggaaggttgggaacaagatattcacatggccttaaagtatcattccacagattattcaacaattacaaagaaaagaaaattaatttttacaatgaagagatctggtgttcaccaccttaattaaggactaaacttgacaacaccaaaagtgggacaagctgacatgatatgcacccgatatgatgcaaaccatttacatgtactttgtagattttttttatagtatttttgccaaaaaagtttagcctgaatataatcaggatgaaatacattcaaaatgttggacattttataagacagtgggtcgaaggccgggcgcagtggctcacgcctataatcccagcactttgggaggccaaggtgggcagatcacgaggtcaggagttcgagaccagcctgaccaacatggtgaaaccccatctctactaaaaatacaaaaattagctgggcttggtgacgcatgcctgtaatcccagctactcgggaggctgaggcaggagaatcacctgaacccgggaggcaaaggttgcagtgagctgagatcgcatcattgcaatccagcctcggtgacagagcgagactccatctcaaaaaaaaaaaaaaaaaaaaaaaaaaaaaaaaaaaaaaaagttggtccagtttgactcaaaagtcaatgtcataacaaccaaagaaagattctagattaactgatattaatgacacgacaagcaatttaagtatgaatctggactggatgctgaataaaataagcaagcaaacaaaaaactgcttgagacttatttgacacaattacggaaatctgaatacgaactgtttattagattagaatcttggttatttttcttaggtatgataatggtactgtggttagacagtaaaatatccttactttagcaaatgtatgatgaagttttgggaaggaagaagaaaatgcaaatttaggggttttattttacatttttccaattttttatggttaaaaaaaatttcaaaataaagttggggaataataggccctgaatagacatttaattatcttacagtaggcaaactgaatcttcaacagttttgcctgaatagacgattatcttacagtaggccaccgaatctttaacagttttgaacactgtaaaatattccacataagcagagtaatctggctttgagttatttatttatttatttatttatttatttatttatgatacagggtcttgcttggttgcccaggatggagtgcagcggcataatcatggctcactgcagccttgatctcctgggctcaagtgatgcttccacctcagccacccgagtagtgggactacaggcatgtaccaccacactcagctactttttaaatttttttgtagtaacggggtctcactatgttgcccaggcttgtcttgaattcctggcctcaagcaatcttcctgccccaacctcccaaagtaccaggcgcatgaaccactgagcccagcctgagttcttattttaaaaatgtctcagcattattaaaagcaattagaaaacaaatagagcactccttctcaactctggatttatcagatcaccttcctaaacataagagaaagctaaaaaattaatgcatgaatgaataaatattatatatttatattctacatgttgactgctctattcaataaatttactatgtttattgaaaaataatgttttctgggaaaattactgtcccaaccagagatatcagttatttataattctccatgattagtatttgttcctttacaattagaaaaaaacatacttcaagggataatttattagtataatatgccctgactctggggccattctgcatgtattagaagactggctctgacaattgttagatatgtgatcttggactagttatttgcaactcacatctctgggaagaccttcttgggctatgccagtctttaataatctgtattatttattcccaaatattagtcaaaaataaaattcactgataaaatgaatacataaagttagcagatttaatagacttctaaactaatgcccaaataatttaattgtgctaaccaataatcaaataccaactatactaatttctacctaaaaccataaagagttgcctacaatttttagtatttgataaatttcctcagtaaactctaatatggattgaagtctgttcaaatcgtatcgtttgtgacatgctctatatattctatctgaggctagcaggatgtgttcctaataaagcctgccacatatttattacactggcaaagccaacaaacttcaattctgtgtgttcaatccttaaaatataatttaatatctgtctttaacattattttaacaataatgttatagattgaaagtagattaacaatagattaacatagatttaacaatatattatggactgaaaatcaaaagtataaatataacaaggataagaaaggtaaatttataatttcagtatttcctttttactgatttgttattacaatgcagagttaaaaaaatacaacaacaaaagaagcttcttgtattttcttgtttcctcctttttttccttactgtctttctgggtaagaaacatccaagttatccacctcatagtcacccctaatagttcttagtttcttttcactaaatagcctcttccagcttatctcattaactcccatgggctcaaataccacacatataccaatgactccttcatctatacttacactctaagcctatattccaaaatacactgtatagttcctagcacagggcttgactcatagtaggatatttaataaatgaggttcaaatgattgagcaagctattagatatcgtgtttcagaaatgccataatatcttgtaggcatttcaaacttaatatatctaaaatacaattcattatcttcctctcaatattcctgtatctcctattttcatttatggattgctatccactcattcacctaaattagaagcctctggcaccctcaaattctacttctctatcttcactcacattctagacctccacgttaatgatttaacatctccactctcttacttcaacccccttctcctacctcaattattaaatcaccttttaactggccttcctagctgtaatgccctaacaccttttatgattcttctcatcttacaattagttcacatactgtcttctctatgaggccttattgtcttctttaacacagaatttgttactatatcatctgcattctctagtacactttgttcattccttttacagcaaatatcaaactatgcaatcccatctacctacctatttaaaaataggtttccagtgaatactagcagtgctagggatggggctgagttctgcacttcattcctacaaggttctgtacaatctgggcctgctgctacctctctgaacttactgttttctactctcctccttgttccctccaatctagctatactgacctctttgctgttcaaaatgcataccaagtacattcctgtttcaggatcttggatggggatgctattctcccaaacaacttacagcttcctagcttccttccttcctagcttccttttttccaagctcccttccctttccttccttccttcctccctccctcccccaactccctccctccttccccttctccctccctccctccccttcaccctctccctccctccccttcccctcttcctccctccttccttccttccttcctccctccctccctctctttcttcttctttgtcgtcatctgaattttgcttaattctcagctactttgtgaagctttccttgaccactccatttaaacagcaacccaaccctactcctcaggtgcaactcccttccctgctttgtcgttataatgtttttatttaacagccctctgcatccatgggttctgcatccacgcattcaaccaaccatggattgaaactattcagaaaagaaatgcatctgtaatgaacacatagacttttttcttgtcattattccctatacaatacgggacaactatttatacagcatttacattgtattaggtattataagtaatctagagattatttaaagtatataggaggatgtacacaggcaatatccaaatactgtccattttatattggggacttgagcatccaaggaccttgctatctacaaagggtcgtaaaaccaactacccagatactgagggataaccagactacatttgcttaatgtcattctccactagaaggtaagctacacaaagatgtggagttttaccagttttgttcactgatacgttcagagcatgtataaaagtgcctgggacactgtaagtatgcactgggtacttactgaatgtataaatgctcttgcattcccagtacctgcatgtgtacaaattaaacatctttttaagtaaaataacccccccccccccaaaaaaaaagtacaaagttaaaacaagaagggatttaatggtggaaaacattttttggtccattacattggtatggtattgagaatgtgagatggtgtgaacccattttttccaggtctttccataaaagagacattttaagttctagggaaaacttttaaatttaaactttgaacataagcatgatgatttagaaaaagattttcatatccaaagcaaagagaagttatttttaaaaatatgcttattatgttattttttccctgcagtagttcagtgaacattaagcacattaatttgcctgttatatgtgcatttatatctgccttttacattagcttttaaagtgttttactttcaactcttcattaaatcttcacttcaaaatcagactaaaaagactgagataacattatgcctcataatgtcactactgaagaagggaaaaaaaaaggaaaagtggactcccacaaaaaacaagcttcactgattctaagttggccaaaacaaaacacctgttcatgccctatatttctcagacaaatttaacagcaatgagatgtaaaagacttgattccttttaaaaaaagtggcaagtatacacaataacacatatacatacaaacacccatatagacattaatatgaaatacaaacacacccacatagacattaatatgaaataaactggagtcctactaagcataaactcacttattctcagaatgccgtaagatccttgggaggcagatttgaagaaagcatactaagatcattatatgacttgtgacacatgagccttacaaaaggccagcaacgaaatccagattctgagttctaagctatcatttagagaactccaaaatagatgatactgttgtatactgcatgggcaagataaatttctaaacaaggccataaaactaagtgcactttataaggatgatacatgtaatcggacttactctcccctctgtgctgccacagtgttttatacgcatgccctgttgaatttaccaccatcatattataactatttctttgcctgctggactccccagatagactggaaagcctctgagggctttcatcttccatttctcgcagtgcttggcagagtctctgttacatagtaggctctccataaacaatgcttgatgaaatgcttcaattaacttttgaaaatattaaaaatgtttttattttttaaactgaataacagttttcattagagtacttctattaaaatgtgttatttctggttcttctcaaaaaaaggatggaaaccagttagaaatcattcttaacttttattccttatgaattacagttgaatgttttcttagagaaagttgaggaaaaaagtaaattgtctgaaataagaacaatgttccactttttacttattaaccatttataacacaaaaatctcttacattgtttaaaaaaaaatgaccagtcacgcatatagtcatttgtcactttccgtatttctcagtaactttgctctcacactggtaggcaagttgctgactaagaacaacacagtgattctttacattttcattcacttttcattcaaggaaaaggcttcttaaaaatgtgcatttaaaattctagaaaatacaaatcaacattatctctaagtctctatcattaccagaaggtctggttcctaaacctaatttccattgttagttaacatcttcaataagtgatggatattcatttccagaaaacattaccagtaaattctattatatcacagactgttcactatccagaccaaactgactaaaccacaaaatgcaaaagtatgcacttcacttctctaagggaaaccttagggctattctgagtatagttttagcagattatgacctaagggtaaatgagagcttaattagatagcctccttctgaatttccagagctttcagtagacacaaactaaaatgtttaaaaactaaaaatttcttgtcacagatttaattttttaaaaagttactctgagacataaggatttacaaaggaaataaaaaaaactgttatttttgtgatacaagtgctatttcatttttcccccagaggaggaaacatgaagagctgcttgcttggttccaggcggtgcccatcctaagcaaaattagtaaaaaaaaaaaaaaaaaaaaaaaaaaaaaaaaatatatatatatatatatatatatatatacatataaaataataataattttttaaaaattggatcacttaccacagaatcacagaatataatggctgaaatgaacactgatgtgaaatatgcgaaaacaagtatatatgattaatttggagaaaaagaccttttattttgtgaattaaaatatttttcattatcagaaatgtgtccaacattttgtatatataaatatatacactgtaatagtgaagaactaaagatggcttaaaattatgattgattgattccttccttcccccctccctttttttttttttttttttttgagacagggtcttgctctgtcacccaggctggaatgtagtggtacaatcatggttcactgcagcctcaacctcctgggttcaatcgattcccctctgcctcagccttctgagtaggtgggaccacaggcatgtgccaccactcctggataattaaaaaaacattttttttaaagagacagggtcccactgtgtggcccaggttggtcatgaactcctaggctcaagtgaatcacctgacgggattacattggtatggtatagagaatatgagatggtgtgaacccatttttcatacccaaagcaaagtgttgggattacaggtatgagtcatcttgctcagccagaatggaatactcattttcttcaaaggcatgtattaagtgtattatcagaaaaaaaaagttatagaaaaacctattttaaaatctaagtatttggaaatatattttataacaacatcattttatatgcccaattatcttaaaaattgaactgtccatttcgatttgagattacaaaattataaaatgcattttatggttgatagtaaactatattaatgtagtcatatcgtcaaactataaaaaaataaagttatgcctggtcaaaataatttagctactttataaccaaccctctcatctcacctgttgcagccatatggcattgttgtaattcttccttcaattctcacttttgagtaaactgattactgagtttcctttaccctagaggcaaagcagtgagttgcaaaacatttactactttcaccacggtataaattatgttccgataaagtagctgaaacctttcaagtcttctactttatataataaaaaccacttattgaaatgttttcaacagtatgcctgaaagttatatttagaaataatacatatgtaccacagaaatatagattttaacataagacatttactaggtttagttctaagaacatagtgctttccctttctaaaatttagtgggaagttagataaatttaaaataaaaacattcaatgattaaagtagttctgaatatagttataaagatacaatctattattcctattgcactgtaagacaaacaaattttggtatttaaaacctttcacttgtagtaaacattttcctgtcctctattttcaaatgacaagtctctgaaatgaaataataacttgctcaagtcacagcattaagcaacagaatatggatctaaatacaaatgcctctgacctccggctaagtgctaccagaatctcatgtatttatttaaataggaaaaataagacacttctagagtccctattcaagctaatcaaaattgcttattaataacatcttcaaaatcatgatgatgaaatgccaccacaaaatcttcaacattaggcaagttttattattaaaagtgttatttgcattcagttttttaaatggtaatctattctttatattgtaacatctgatttgctgggagtcagataatgaagtggattttataaacttgcactggcccatatggtacctgctggctagatgtggtttttaaaatgtaaattggacaggcatggtagctcacacctataatcccagcactttgggaagctgaggtgggcggatcacctgaggtcaggagttcaacaccagcctgcccaccatggtgaaatcccgcctctactgaaaataagaaaattagctgggcatggtggcaggtacttgtagtaccagctacttgggaggctgaggcaggagaatcacttgaacctgggggacagaggttgcagtgatccgagatcgcgccactgcactcctgcctgggcgacagagcaagacaccatcccccccacctcccaaaaaagtaaattaattaaaatgaaataaaattaaaaatttagttcctatgttacaccagcctctagctaccatgatggattgtgtacatctagagttcagaaaagaggtatgggttgaagataaatatctgaaaatcactggcatatgagttaaagtcatgggatcactaagggagtgggcatatatagggaataaaacagggtcaaattgcagtgaaaccatcttataagacatggaagaaaagaggaaaaattagcaaaggagaatgaagagtgcctaatgagataagaggcaaaacaagagaatgtggtatcccagaaaccatgtatttagaagtgatccaatgtgtcaaatgctgctgataggttaagcaagataagaacaaagaattgaccactggaattagcaatgaaaaggtcacttttgagcttgaaaagaagagattagagatttcaacaaattcatagaagacggaaaacgattagaaacatctgtctgaaaacattattggagggctgtagtagatatagaagctatctgactatgaaacctgtgaatttggaatcagcatatttgtatgggggaaaacctgactgaaaaccaggagaagtaacagaagattcatttgtacaatacgtaagctaaacaggctgtgaaatccctggaaagtgaaggatgcccagcattaacagcctgccacaaaacaaaaacaaaaacaaaacaaaacaaggaaacattgattgatttaggaaggtgtaatggcagaaatcagtgtctttaaattctttcttaacttaccccagacacataagtctgaggctttaatatattcacaacatttttaccatttttatgatgttatagcatttaccaatgggagaacactgatcacactgtagtgagtaactgtctacttctaacaaaaaactgttgactcttgaaggcagggtgtataatttttaatctgaacaactagcacaaaacatatcgtctggcctactataagcagttcagaagctgaatacaacaagtggtttctgaaggataaaggctgaattagaaatttggtgttaattcctaatctgaagttcattcctccacgtatcagtgcttctgtcaataaacaattgtaacaaaacatttttggtaaaaaaaaaaaaagcaccttttcttccattttgatgttatctactatagaaaagtgttttgtttttttttttcttttttgagacggagtctcgctcttccgcccaggctggagtgcagtggcatgatctcggctcactgcaagctccgcctcccgggttcacaccattctcctgcctcagcctcccaagtagctgggactacaggcacctgccaccgtgcccagctaattttttatatttttagtagagacggggtttcaccgtgttagccaggatggtctcgatctcctgaccttgtgatccgcctgcctcggcctcccaaagtgctgggattacaggtgtgagccaccgtgcctggcctagaaaagtgttttttcttttctttttttgttttttttgagacggagttttgctcttgtcatccaggctggagtgcaatggcgtggtctcagctcactgcaacttccgcctcccaggttcaagtgattcacctgtctaagcctcccgagtagctgggattacaggcgcccaccaccatgcctggctaatttttgtaattttagtagagacagggtttcatcatgttggccaggctggtcttgaactcctgacctcagctgattggcccacctcggcctcccaaggggatcataaggcatgagccaccccacctggccttttttcttttttctttttgagacagggtcttgctctgtctcgacctccaggctcaagtgatcctgccatttcagcctcttgagcagctgggactataggcacatgccactacacctggctaactattttgtattttctgtagacagagcttcgtcatgttgcccaagctggtctcaaactcctgagctcaagtgatcttacacctcagcctcccaaaagtgctgggattacaggcatgagacacagcaccttgttgaaaagcattttcttaagagaggaaaaactacaggttgcaaaatggaattatatgaagtatctcaagattttttgatacctctggggattatgttcttagagatggtcaaattctaagagaaacagaggctagcaaatggagttctgttgttgcttttgttctattttaatgtctgtggaataaaggattgtcccccaaccgaacccatgccctgtagattttggccagattacacagatgagagaatactttgattttaatcatcttaaaatctcaatgttatctcattacatgccaaagacggcttaagggtggtactcgtgtagaaagctaaagtttggaaagttaagtgttctagtggattactcaagtttaagatgcttgacaactttcttcttgaaattacttcatcttaatgccttttttggcatgcttctaaaaatactatatccattatttgtctctttgacatgttccttttcctataatcatcacttaacaaattttattaagttgtatcttaaaatatcttccactcttttggcaataaaacaaactgtataatttcaaactaaaaaaaaaaatcaaaaaagcctcccataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcctgctgacgtcagcgcctgcctacgccgccgttcccatggcgaccgatgcgtcccgcgctctaggcgaagaccgcggccccgtccccgcgcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggtaagggacccggaaatgcgcgggtgcccctacagagtcttgagttttccccgccctcacctccgaaaatgctcttttcgccttagaattgtagctagcgcagggaaaaactgactgggcaaaggaaaactggggaggctgtcatggaagccgcccagaataagaaaatgaatgaatgaggcaaagaaacagatttgtcactccccacgcgatcgcgcccacaaaagaaaacatggttttaaggcgtggaaaatgaagttgtactacagacaaaattttaagaaaaaattatccactgttcctttagagctatctccctgtgtgtgaaaaacaaaacaaaagttaaaacgccatccttttctacacctaatgctccctcccacttttctgatttctgccacaggcgccatcttcagctctgagtcaccagggctggaaaaatactagatgcgctactcgtggactcgtgaatacactcgtgaatacaggccatttcctgtacctacagccacccgctgtaagctgttgcttcatttgtacagtaagagtttatggaggccagcttttccattcttactgacattgccacaccttacaaactatatgtcttgtgcttccctaaatcctgtgaggaagcaacgagaaagattactaatccaatgcgtaccgaactgagctgttcaactttccgttctaaacatactctcctagatttctatcttgctgtaagccaccacaatcctcccagtgttttagtaagaacagtagagtatcctaaatgcatcttatgccaaagcatatccattctctctttttaacttcctcagatgggccctttaccagttctctgactccagtttgactcttaaattctccacactgctatcagaatgacctgactaaaaatgtaaatcggataatggcactctcctgctgaaaatttttgaaaggcaatctgtaagagaaaatgattactttgcctaggatacaagattctccatctccctgactagtttcatctctcgttagcttcttgttccaattttatgcaatattgaatcatgtgtaccatgcagttttatgcaacattgaattatgtgtaccatgaaaaacaatccatagcctttcacgccccgtccttactcatattgtcctctcttcctgaaaattcctccttttacactcctgcatcacagccaaatgttgtccatcctttgaatcttaagcaggttgactgactccttcaaacactcctactccctattagacttcggatactcattctatatattagactttggatgctcattctatagtttcatagtttactttgtattttctctatccccagcatctaccacagtgtctatgaaatagttggcatttcatgaacatttgttgaatgaataatggataacatatattgagctccttctaggaggtatgcattgtaggtgttttatgtacttttcatctgtcctcacaactgcatttaagtacctgcttttccaaagggaagttataactctgactgctcattcttagtagggtgttagtttcagaatacaatccccagactagcggatgtgtaaccctgttatcatctcttgcttctccatttacagtagcatgcagaggtgcagtggggtgggggaggtcagggaatatttcatagcagaagtgacatttaagtaaagaccaaaataatgtgtagagttgtccaggttaggaagggtttccaggtagaagaaggtggcgtatagtgttcactacaagaaagtttggtataatacaagaactggaagaaaaaaaaaaaaagttcaagttggctaactaaaaggtagagaatgagactaggggcttttggaggagacaaaacaagagagttaaacaagctatgaagagacccagacagtattggtcagtggaataccactatagaattttatggagtgaaattttcaaattttaatatcataaagataactctggctgcagggtggagaacagacaggaaggaagcaaatctagatctgggaataccatttaagatgccgttgctgtaagccatgtaagagacaaaggtggcatggtcaaggctaagaaaaatcagaatggagagaaatggaccaatttgagaaatttttaggaggtaaaaatgtcaggacttagtgattgattggatggaagagtgaatgataagaaataataaaaaacgatgaccagctgttttgccttccccttggcaagtaaagaggtggcaagcatgaaaggggagtgaggaaataaatatgttgggtctaatgggagccaggtttctcactgacagagaaggacgttacaaattgagagaggaagaattccacagtgacctttgtggtgatgttgaattggaattgaatatgtcagtgtcaactcatagttttcaatatatacataaacatatgtaaaaataaatatagaggaaagtatgtctgtatgtgtgtgcgtatctatctattatgctcttcctagctctatctgctgaaagggtttcagagtaatggtatactagaagcaatgagcacatgtgcctagatcttggtttctgaacagtattattcactaaaagtaactgggtcccttggagaaatggttgattttagaacaggagcctggaaaattcttgttgcaccagaagttaaggaagttaatacagaatgaagaaacatatcaaaaggtcacagaagccagcttgaaggagccaccactggccacatctgggtcaatctgagcaccaatataatgttaatggattatagtccgctaaataaaataggaatatttgagcccatactaaaatgaataaatgatttttttgaaaaatcaggataaagaaaagctctgccttacataaaaatgccaactaaatgtaatgaatgtagacagtgttatatgtagaaacatcattatttggcagtcatgatagtaacagttgattcagactagaatcatcagtgtatgctaaaactagagggtgagagtattaagagacatataatatttatatagtctcaaagtatctctccagcaaatacttattaattacacagagaaaaattagaaaacttgacagtgtagaaatctggcactggtgagcgaagttaccatcagcagtcatgagacaaatcagcatcgtgtatgtcctggttagaggcacttagaatacacttctgtgacattcctgccaaaaatgtgtaatccgaatcaatcgtgaggaaaaaatcagacaacccaaatgtcccaaattgagggacattctacaaaataatagacctgtactcttcaaagatcaaggtcatgaaagacaaaggaacaactaaagaacgtttttagattgaaggagaattaagatacatgacaattaagtggaatacatgattctgaattgaatccttttgctataaggatattattgggacaactaacaatttgaatggggtctctggattagatggtagtattttaacaatattaatttcctgattttgatgactatagtgacatagatatttttggttttagaaaatacatattgaagtattaaaggtgatgaggcttcatatctgcaacctattcaaatggttcaggaaaaaagtatacataaatactgtaaataaatataaacataaataatatacataaagaaaatgataaagcaaatgttaacagggaatttgggcgaaagcagaagttctttatactattcttgcaatttttctgtaagtttataattattttaaaactataaaagaagtttgaaaggtgccgaggtttctggctcaggtaactgggtggagaatggctaatcagttaacgacaaaaaatcaggaagagcaagcatggaggaaaagatgtttagttgcaatgggatgtatggagtgggatgttcagcaggcagttgagtatatactaaacatattaatgagccccattcaaactgaataaagcagatatgttgctttagctctcattagtcgagagtgcaagaccaagggcactccgctatcctaggagaggcaaacaattaagagtggtagtatggtaataattctaaaaattggctgagtatccatgaaaaaaattgtgtgtatatatatatatatacacacacatatatgtataaacatatatacacacatatatgtataaatatatatccacatatatgtatatatatacacacatatatgtatatatacacacatatatgtataaatatatatacacatatatgtgtatgtgtgtgtgtgtgtgtatatatatatgtatgtatataaattgaaccgtttaggaataaaatagatttagggtattcgacacatttaatacataatgaatagtgaatttcttgaataatataatgcctaaatgtgactgatatgcaaaatatttaaatcccttacaggatgtgcatttaccaatcagaacagatgttggctttactgcttgtattagttttctgtattagtttgcttgtattagtttgctggggcagccataacaaagtaccacagaaatttatattctcacaattctgggggctagaagactgagataaagatgtctgcagggttggtttcttctaaggactctcttgttggcttgtagatggttgttgtctccctgtgtcttcacctgcacttccctctgtacctgcccgtatcttaatctcttcttataaggacagagtcatattggattagggctcaccctaatgacctccttttaacttaattacctctttagagactctgtcttcaaatacaggcacattctgaggtactttaaggttagaacttcaacatatgcatttggaactggggcataactgagtccatgacactattggagagggttctggagccataacagatggaatgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaaaaaaggaaaaaatactcaataccactacccaagagaatctaaattaacttttttgacaaatttcgtttcagtctgttttccatgcgtattttaattttggtcatgttgtgtgtaaaatgtttatttctgcttacttgaatgaacattatgttgcaatttcatttccatgctattacaatagtgcccccttaaccatggttttgctttctgaggtttcactcaacaagcttggtttgaaaatttttagagagaaaataagagattacatttacataataactattaatacagtatattgttataaaaactttatattgttattagttattgctgttaatctcttactgggcctaatttataaattaaactttatgagaggtgtgaaagttgattatagaaattgggtcattcttgttgtacccaactaaatcagagtgaagggcccaggggaaaaagcatttggggcatatagcatctgctccaagaattaaattttccacaagcccagctactgaaactgcctgttgtaatctgaaatcagttttatctgatagctaatgaaataacctgctgtgacactaagattagttttacccactgccatcactcgccaatcagagctcgccagctccccaaatgttacccattgtttctttgcaaaacaatgggtaacatttttcctttttataaaacctccaacctgatctttgtttttcagacatactgaagaccacccattctgtgtgtttgcctggaaatgcaattctcatttcccaaataaaatgtttgaaatgtggaaatttgactctatgttttatttgactttgagaaaggcatgcaagtatagtaaatacaggctttgctactacctgtagtttcagacatccactggggatcttggaacatatcccatgcagataagaaggagatgctgtatatatcaccacttaatcatcactggaaattctaactttgttagtaatgttcttatgtgcacgtggaaaaatttcaaacaatcgttcagatatttataatgtggtaaccgaaagtcagccgtgtttttaatcactgatcagtcttctatacattctttcatacttccattcatacatatactaaatatactaaattataaagataacttcttaccatagattttgtcctgtcatcttgtttttgtcctttatcaagtattattatttctaaaaggctttttatgtcagtaacatatatctaccccattcattttaatggctttatgctatatcacttctaatccaaagtgtttttaagcaattatagtgaaagtgtcaaaaggtgatatggtggcttttaaaaaataagatacttttcttataagtctctcatattattatttattcctcagcattttatagatttttggtgctattttgaatgcatccaattcttattacattttctaaccggtgattgcacattttcctgcttttcctctttctagggctcctttactagttcatgcctatcaccttgacctcttgatattggaatgtcccagaggtatgttcctggacttctctatctacacgtactcactcagtgatttcttacagttctatagtcccactgtcatgtagactactcccaaatatatcccttctgcccattattcttccttgaacttcagactcataaatctaactgtatattacatgtctccacttagatgtccgacatattctcaaacttaacttttctaacactgaattcctcatctgcctcctcaaatccccactttctccatctcaagcaatgacaactccattcttccagttactcaagccaaacaccaaatacattggagtaactgttaaatcaagcttagcctaaaactacctccttacatattttaaattcagcctaaatgtttctttgtacatcttaaactataacaagtagaagtgtaaccagatgtagcctacacttgggccaatcaccaagttttggccaatcaaatgtcgtcaactattcaaaccatgtttaaataaggcaaacacaaagctgtaaccaatccagctggttctgtacctcacttccattttctgtgcctcactcctttttctgtccataaatcttccagcacatggctgcgctggagtctccgagcctactctgtctgggaaggctgtctgatttgcaaatcattcactgctcaattaaattcctttaaatttaattcagttaaagtttttcttttatcataacctttgacctttctccttttcttataccccatatccaacctatcagattactataggttcgaacccaaatcctatgaaacagaggatatggttataattttgagggaagattttttttttctctacctgaactttagcccctacaaacaaacttccttgtttatctttgctgctgtaatcttttaagggttccacttttatgcaaacatcttagttctcacactgagcaaggccttgaatcctatgctttgggaggccattgcattctaagactacattcctggcatcagcaagtgcccctctagtaaaaatgccctcagcccctactttccactcttgttttagttctttcttctctttggcccccgaggaattcaatgatgcaatttagtcagcatttctagctggttttcaggttttttttttttttttcagagtatctttgtgacatattgggaaaagaggaattccttctctctcaactgttaatacatgttgaaaggaattttatgagtaatagtaatggctttgtaatagtgattgttactcaaatttagcagatgacttactgaagtaattaaaccttccttataccctttctgtgggtggcatgccacgaaaactcgatcaacctgtatacatgggttaggtagaacccactgagctttccattatgtataaagctgtctgtagatttactggctgtgtataaataccattttattaggaaaatgttttggtttaggtctcagaaggtcccatgaaaaacagtaacttctgcagagactaaggggaagagttaaaaaatagtaataatttaaaaatccatttcagcatatgattaattcagttgtctaaagcaatgagcactagatggcagcatatcaatgtgtatcgttacctgtgcctgaaagacctcattttaagggtgtgtaaggtcttattgctgttttaccatgcaccagtttgctatcctgaactatttactttactgtttaatctgttggtttgaacttataatagttgatgagatgtatttgacaccaggtttgaaaatagagtttctagattaataaatatacaggatggtgccggtaccaccagtctgtctagcaaaatatgcaagaattcagagccctttcctgtcattaaaggccaccctccagagagcttatctttcatctatgataagaggtcttctggttggacaaaaagcacattttggacactcattcctgtcttgagtttcaaaccttttgtggccgctaatgtttaacttttcatcttactattcaaatggcatctctttactagattggaaaccactttcgtatctcttaccaagtgtgaaaataggggcctcccaaactctgttgtgggtagttaccaggtcttcttctctaaaggactcaggtcagatatctctgtcacagatgagaaaggaatttccttcttatcacatttgattgtataattagtatttaaaatgtaaaaaagaaaaaatgacataactttaatgtataatttaactggatggctccatttttctcttgttaactcagatcatttataattttttttcttttaaaatgtttagaataaattattaaagtacatgttaataatacaggagggggctgggcacagtggctcatgcctgtaatcccagcactttgggaggctaaagcgggcggatcacttgaggccaggagttcgagaccagcctggccaacatggtgaaaccccgtctctacaaaagtacaaaaagttagctgggcgtggtggtgtgcgtctgtaatcccagctactcgggaggctgaggtgggaggatcgcttgaacccaggaggcagaggttgcagtgagccaagattgtgccactgtactctagcctgggtgacggagcaagaccctgtctcaaaataataataataataataataataataaaaaaaaatagataaataaagggcttacaaggaaaaattccaaatccctgcttcacctattccttgccacagtactgttcctgagaccaaattggcttaaatagcttctgtttttgtttcttctgatgattacccatctcttactactatttcttgattcatcagttttaaatattgtcttaatctattgtggagagagatgggcagtgatttaactcattagcattgccttctactgtccctatccatctcttcccaataaagtcatagaaagaggcacagcagtataatagataagagcacagactcaagtcctacttgcaccacttgctggctgtataatcttaggcaagttactcaagctctctgagcctcttttttttctcatgtgtaatatggggataataatagtcaattccttggaggattattgtgaggataaatgtgtcaataaatttaaagcactaaacaagtgttactattactattactacatttaatttctctttgcatgtttaaataacatacttgcccctttgtttttgagccctgtatgtattatctcttgatacctcccatcgtaagaagatattgacaactttattcttcccttcactcccgccctcttctgcatcttaatctcaccttttattccatctctaactgcttttctattctctgggagatttttttaaacttaatcttctaaccatatattgaaaaatttactttagcaataacatttataatttctgagagttttatttctaatgtttaattttatagaatttaaagattcagtattttcttgactattgtgttagagttcagtcaaagagcaaaaatgaccacacccataatttggatagggaagataactgtgaactaagtaaaggatgtattaactactaagagagaactgtaaaatataccgaggtagtagctgcaaaaagtacctgctactcctaggattgaggaaaaattgaataaggaaggaaactggaatctccagaggcagagattcaggcctgagtgggcatggttgccgcaggaatgcccctctgctgctgtgagaaacaccggagggacccttgcatgcctgacaagaggaaaagaacaccagaacaaaaattgcctcttgatcatggcttatgatcctttggatgtgctgtggaatttggtttgcttgtccttggttgaggatttttgcatctatgttcaacagggatttgggccttgtcatttcttttcttgtaatgtccttgtttggctttgatatcatgctaatgctagccttgtgaatgagtttgcaagtgttccctcagcttcaattttttggaagagtttgacaagagttgctgttacagtaattaccagtgaagtgaaagagctttgcgctttttgttgttgttgttaggaggctcttgattaccgattcaattcccatactcattattggtctgtcagattttctgtttcttcataattcagtctaggtaggttgtatgtttctaggaatttatctctgtcttccagtttatccaatttgttggcatttaattgttcatagtagtctcttagaatcctttgtatttctgtggtgttaagttttaatatctcttctttcatttacaattttatgtatctgagtcttctcactttttccctcagtttaagtcttgtcaattttgtttatcttttcaaaagataagcaactctgagttttgttaataatttctatttcttttctagtgtctattttacttgtttctgctctaatctttattgtttcctaatttctagtaattttgggcttagtttgttctttttctagtttcttgaggtgtaaagtcagattgcttatttgagatctttcttttttctaaattattatttattattattattattattattattattatactttaagttttagggtacatgtgcacaatgtgcaggttagttacatacgtatacatgtgccatgttggtgtgctgcacccattaactcgtcatttagcattaggtgtatctcctaatgctgtccctcccccctccccccagcccacaacagtccccagagtgtgatgttccccttcctgtgtccatgtgttctcattgttcaattcccatctatgagtgagaacatgcagtgtttggttttttgtccttgagatagtttactgagaatgatgatttccaatttcatccatgatgtccctacaaaggacatgaactcatcattttttatggctgcatagtattccatggtgtatatgtgccacattttcttaatccagtctatcattgttggacatttgggttggttccaagtctttgctattgtgaatagtgccgcaataagcatacatgtgaatgtatctttatagcagcatgatttatagtcctttgggtatatacccagtaatgggatggctgggtcaaatggtatttctagttctagatccctgaggaatcgccacactgacttccacaatgattgaactagtgtacagtcccaccaacagtgtaaaagtgttcctatttctccacatcctctccagcacctgttgtttcctgactttttaatgattgccattctaagtggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatttcgtaggttgcctgttcactctgatggtagtttcttttgctgtgcagaagctctttagtttaattagatcccatttgtcaattttggcttttgtcgccattgcttttggtgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccattgattatatagggaatcctttcctcattgtttgtttttctcaggtttgtcaaagatcagatagttgtaaatatgcggcattatttcagaggactctgttctgttccattgatctatatctctgttttggtaccagtaccatgctgtttggttactgtagccttgtagtatagtttgaagtcaggtagcgtgatgcctccagctttgttcttttggcttaggattgacttggtgatgcaggctcttttttggttccatatgtactttaaagtagtttttttccaattctgtgaagaaagtcattggtagcttgatggggatggcattgaatctataaattacgttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtctgtcatagatagctcttattattttgagatacgtcccatcaatacctaatttattgagagtttttaacaatccgagtctctgataaaacagactttaaaccaacaaagatcaaaagagacaaagaaggccattacataatggtaaagggatcaattcaacaagaagagctaactctcctaaatatatatgcacccaatacagaagcacccagattcataaagcaagtcctgagtgacctgcaaagagacttagactcccacacaataatagtgggagactttaacaccccactgtcaacattagacagatcaacgagacagaaagttaacaaggattcccaggaattgaactcagctctgcaccaagcggacctaatagacatctacagaactctccaccccgaatcaacagaatatgcatttttttcagcaccacaccacacctattccaaacttgaccacatagttggaagtaaagctctcctcagcaaatgtaaaagaacagaaattataacaaactgtctctcagaccacagtgcaatcaaactagaactcaggattaagaaactcactccaaactgctcaactacatgtaaactgaacaacctgctcctgaatgactactgggtacataacgaaatgaaggcggaaataaagatgccttttgaaaccaacgagaacaaaaacacaacataccagaatctttgggacacattcaaagcagtgtgtagagggaaatttacagcacttaatgcccacaagagaaagcaggaaagatccaaaattgacaccctaacatcacaattaaaagaactagaaagcaagagcaaacacattcaaaagctagcagaaggcaagaaataactaaaatcagagcagaactgaaggaaatagcagcaaaaaaaaaaacccttcaaaaaattaatgaattcaggagctggtttttcgaaaggatcaacaaaattgatagaccgctagcaagactaataaagaaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaagtcctccacacatacactctcccaagactaaaccaggaagaagttgaatctctgaatagaccaataacaggctctgaaattgtggcaataatcaatagcttaccaaccaaaaggagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacgaccaaaaaagagaattttagaccaatatccttgaaggacattgatgcaaaaatcctcaataaaatactggcaaacgcaatccagcagcacatcgaaaagcttatccaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattctaaattattattaaagcaggctttatctctataaacttctctcctaaaactaattttgcagcatctcataagttttggtatgctgtgttttcattttcatttgtctcaagtttttaaaatttcttttttgatgtcttctttgacctattggttgttcaagggtttgttgttaacctaaatgtctactgacagatgaatggataaagaaaatgtggtctatacatacgatggaatattactcagccttaaaaaagaaggaaatcctgccatttgtgacaacatggatagacctagagggcattatgctgtgaaataagccagacacagaaagacaaatatgatctcatttatgtatggaatttaaaatagtcaaactcataaaagcaaagattagaacagtggtttccagggactaggggaagggggaagtggggaggtgatgattaaagaacataaagtttcagttatgcaaaataaataagttctgaagatctactgtgcagcgtagtgcctatagctaaaaacactgtattatatactacaaatttgctaagggggtagatcttatgttaagtgtccttagaacaaaaaaaaaaggagtggagggcagaagaaattttccaaggtgatgaatatatttatggctttgatggtggtgatggtttcacaagtatatatttattctcagactcactgagttttatacattatatatgtatagctttttatatatcaatcatacctcaataaagtagtttgaaataaaattaaaaacaccccctccaattctgacctcagtgtccaaccttgcagtttcttctcccagtgacctctattaacagagcctacatggaaccagccggcaaagacaagttccactgtcacaactagagaaaagaggatgggtttggaattgaaaggtaatagattattaactggcataactatctgtgaaaatattcaataaatagactgtttccttcaaatccttgaatcatttcaactttctcagtggactttttaatcttggtttatctttactggcctccctttaattctggagcctttaaaaagtgtccagggttccttagttacttgttaaaaataagggaatgaaaagttgattggttgtgggctgggcttgtccattgatcaactttcctttagggtgtttggatgggaaacaaacatactgactgcccggcttttgtccataacatgcagtttgtatagagaagaatcttctgcctttttgctagagtggtaaatccctgggttcccacttcttggggtaagggagttggggggcaattttaaccaacactaattttcaattaataccttcattttctactatatgcttccaattggtgttttctgagcttctctgtatttctgcaaggccaatttactcagcttccatagaaaccatttgcattaatttcttgtggctacctgtaacacattgccacaaacttagcagcctttggaacaatagaaatgtattctttcacagatctggaggccagaagtcaaaaaaatcaaggtgtcagcagcctagagtttttgacttctggcctccacacctgtgcagccctcccttcagaggctcggcagggaatatgttccttgccttgaccagcttttggcagccgttgacattcctcagctggcagctgtgtcactccaaatctccgcctttgtcttcacaggcccttctccttgtctatgtaatctgctccctgcctcactgttaataaggacagttattgttgaatttagggctgcccagaaaatccagagtgatcttctcacctcaagacccttgacttaatgatatctgcaagactctttccaagtaaggtaacattcacaggctgaggaatgaagacatggacatatctctttgattaccaccattcaactcactacaccactcttctaactgcttaatctctttaggaaatttgatgacctttcttgtttgctaatggcctgctttctgtcctttttattctttattgattttgtgtatttctctctcttgctctttctctctctctttctccatatatatggagaaacacacacacacatacacatataaagtatatataacaacaaatatatatacatacacacatatatataaaatatacataacaacaaatataaaatatgtgtgtatatatgtaaatatatataataattgtgtatgtgaatgtgtgtgtgtgtgtgtatgtatcctttataaccacttactgggttattaggaataaaataatataaatgtgtgtggttagtccacaatcttgactttcacatatatagtttatttcaaaagaatttttactaggtaatctctgaataaaatcaaattaagctaaagtctgggaaagtacagaacaaataagttaggttatgtaaaagagcttaatttaattagcagtttatgtatctctcctctctcttgctctctctctctctctctagctctcgcctcttaatatttttcaacctgttctgtcatgattccacaaatattcaagtccttcatgtttccagggtaacagtaagtattcggcagtttatctgacaccttccatttaagataggaaaaaaataatagaaagaaaatgtcattaatgtatgcaaggctgaccattatgacatttggctgtctgttatctttacaaatacgttctcttctttcccatgtttctggttgcaactttctgaccagtgataggaataggtggcatatatgctacccacttctccaacttgctcttgtccgtgattactaattggttatataattcattttcggtaagcctggatataggttcaaaattattttctatacaatattaaggaggcataacaatttattggagctggcatgtaaattgaaaattgcttgctgtttatgctccaaactttctacctcacagatctcatgactcgaatatattttaccactacagttttctcccatagttataattttgtcattgcttctgctctaaccaagcagttagagaaggcagtacaatatagtcaaaagagcactagattgggtgcaaaaaagcttgagtttttgttctatattaattacttgtgttatagtggataaattatttatccttctagatctcagttttcttgctaaggcaataaggcaattggactatggtaattcctaagatacttaacaactctaaaaacttttaatatccagcagccaactagatatttccacttaaacgttacatcattacccaaaattcaacccatcaaaaaatcttaattcaatgccctaaaaacatctttgccccttaggtttggtatttctcgtactttgcactctaaattcaaaatcttttagtcatgtttacttctcatcttttatttaccttctatagtttatctattaccaagtactataaattcttccttaaaaaggcctttggctctatccattactttatatatcagctctcactactctgactcaagaatttatgttcccaataaacttgacctttcacttcccttgttagccttatttctagatattttatctgtttttgtggcaattgtgaatgggattgcctctctgatttgtctctaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaagcaatttacagattgaatgttatttctatcaaactaccaatgacatttttcacagaactagaaagaactattttaaaattcatatggaaccaaaaaagagtctgaatagccaaggtaaccctaagcaaaaagaacaaagctggagacatcccagtatttgacttcaaactatactacaggactacggtaaccaaaacagcatggtacttttttacaaaaggagacacatagaccaatggaacagaatagagagcccagaaataatgccagacacctacaaccacatgatctttgacaaagctgacaaaaactagcaatggggaaaaagctccctcttcagtaaatggtgctgtgataactggctagccatatacagaagattgaaactggacccctgctttacaccatgtaaaaaactcagcccatgatgaatcaaatacttaaatgtaaaactcaaaactataaaaaccctggaagatatcctaagcaataccactctggtcagagcaacaagcaaaaatttcatgaagacaccaaaagcaattgcaacacaagcaaaaattgacaaataggatctagttaagcttaagagattctgcacagccaaaaaaaaaaaaaaaaaaaactatcagcagagtgaacagacaacctacagaatgggagaaaatatttgcaaactatgcatattacaaaggtctaatatccagcatctataaggaacttaaacaaaattacaagagaaaaacaaccctattaaaaagtgagcaaaggacatgaccagatactttgaaaaagaagacatacttgcggccaacaagcatatgaaaaaagcttgatatcaccgatcattagagaagtgcaaatgaaaaccacaatatcatctcataccagtcagaatggctattactaaaaaataaaaataaaaagatgctggcaaggttgtggaggaaagggaacacttatacacttggtgagcgtgtaaattagttcaatgattgtggaaaccagtatggcgattcctcaaaatcctaaaagcagaactaccattgtgcccagggatcccattattgaatatctacccagaggaatataaattattctgccataaagacacatgcatgcaaatgtttattgcagcactattcacaatagcaaagacatggaatcaacctaaatgcccatcagtggtagactggataaagaaaatatggtgcatacatataaacaaatattatgcagtcataaaaaagaacaagatcatgtattttgtgggaatactgaataatccttactgtcccatgaagtaggttctaattatagataagaaaactgagatacagggaaactgagcaagttgcccatgatagctagtaatggatggagacataatgtttgaactcaggcagttggattcagagcctggattcctagtcactgcacagtgtcaatgcctgacagatagatgttacgaacgttaactgttatattaattgctgtacattttatcaactagatatccattccattctctccacagccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagacgtaagtttctctcatatttaaaggagagttatgccatatgctctcataatcatgcatatttccttgtccacttgccaaaatcctatttctccttcaagtctccttgtaaataccatttctcctttgaaggagattcaattctcgattccccagggtagactaggtattaatacttatgctatgctctaatggcctttgaacacacatgccacaatacatttatatatacaatgaatgctggtattttatatcccttttttatgataagcaccttaaggacactgctgatgggtatctgtcttagttgttttgtgctgttgtaacagaatatctgagactggataatttataacaaacagaaatttatttctcatggttctggaggctggaaagtccaaggtcaaggtgacagcaggtttggtgtctggtaaggacctggtcttcatttccaagatggcaccttaaactctgtatccatgccagaagagcagaagagagtgaacccattctccaaagtcttttttatagtggcattaattcattcatgaaggcagagtccccatgacccaaacaccttccattaggctccacctcccaacactgttgcattagggattaggttttaatgtgagttttggagggaacaaaaacattcaaagcatagcactgtccatctttgtattttcagtatttgtcacagcactctgcacagagtaggcactaactaattactgtataccttaactgactttcattctttctataccactcagaaaacatcaaagccatagaaacacaaagcctccctcccactaggtttttattttaatcagcagttctcaaaattttaagaaatgggatttcttggaaaaattcaaaatattttggggagaaaccacaactgggtttgctaataaatgctgatatctaagtactgagctaattctaacaaaattaagatttgattaaactgacctagaccaactgtgagacttgggtgggatggcagagaataacaagagagaacagaagaaggtactcttgggctgaccactggttcaatattcctagggtgcccttgctgtcccagaataattatcatgttctgggctttgttctatgagttatagctactccttttttcccacttgtgtttctcgcatctgaatctccctcctttaagccttatttaccctgttgataaagctaaacttctgttttatctccaatctcttgtaatttatttatttatttattttagtaatctcagacctcttatagaattgagcccctgttgtgttctttctagcctcttttctgtaaaactacagaaattctcccaatcttagcttagttgccaagttcctgcctttaatggacacactaactagaaaaagaacttcaaattgcctgcattgataatagcatagtggacgtgtgtgtgtgtgtgtgtgtgtgtgtgtgtgtgtgtgtgttttctgcccagcatccctttcctctagtttggtaaaaatacgttcattttaatatgaaaaataatcccctcaccctcttccattgcatgtggtcttacaggggatgtcagtgaaagagccctacccaaggcattgacacttggcctaagcaagaacaatccattatttctctgcaaactaaatctgaaatggtcttcaacagttaagatgttagtgatggttaaccatctttagggagctgccatcacagtaaccatcactaaccatcttaactgtttaagaaatgggatttcttaaatatagaacctagcccagaacatggtaattaactgtttaagatggttagtgatggttagcgtgtgctggcagctctttaaagagactattcattagtcctgaataccagattattggggtcgtcctgtttcctgtagtattctacttaatgcttgattgtttagctttttatttagttctgtgaaagactccatacctttccaataaattattttttgtgcccttaaattagatagggttggtttacattttaaaacccaaattgacaaatgtaaattccttgttgcagtgctctctcagcagctgggacccggtcttggaatcttagtgtcaactatgatgaatcaccaacactaacaaaaacattatcttttattgggttaaatagtttctactcttcccaagactgggaactgatgtaacaggcttcgtgctttcttcccaacaaattgattctgtgtggtcagctcctgtcatgatgatagaaccccctgtattgatttatacttaggggtatatcaatgtcagtctaaacttgtcctacctacttctactgcctgatgaatctttttattttaatctttactaaggtaaaacttacatattacaagagtcaccaattctaagtgtatagttcaatgatttttagtacgtttatacattacataaccatcaccccaatccagtcttagattgcatgcccaatcttgttgtgtgtattttccatggccattgatggatcctagtatcatgtactgcacgggctataccaatatcaggcccaagatgtgtagcagtcaatcctggaggtcttgtggtgcccttaaatataatgtaaggggagagtgtcagtgtggtggattcaggggcaattactatgctattgaagaagcactgccaagggccaaatagaaaagacactgggctcaaataataaaaatcagcaaggcagacaagaccacaggaaacagggcacttggaagaaatgccatagagtccagtcagctgctgctggatagatctgactgcttttcatagatgtagcacacatctgcttgatgacgtcacctgatgccttctatgccacatgtttcaacttcatttaatacaaattttttcacaaattagaattaacattttaaataaaaggggttgaaaatattaacagataaaagatttgccttggattgaatttttttattcctcctattaccattcattttaatgtgaacccatctgtgagaaaagtggataatttatgtgaataatgtaatgatgctgtattctcctagataatattatactgtttttgaaattatctcctgcccccattccaaacttattgatgaatggcactgtataggagtatcaaaaaactaagtttgcagattcctgagactgagtatagagggctgatgttaatcataagaagatctcatattgaaacagaacaactgcggtaaatttggaagagaataacgctttttttttttggagacagagtcttgctctgtcacccaggctggagtgcagtggcacaatctcggctcactgcaacctctgcctcctgggttcaagtgattctcctgcctcagcctcctgagtagctgggattacaggcgcatgtcaccacgcctggctaattttttgtatagttagtagagacgagatttcaccatgttggtcaggttggtctcgaactcctgacctcgtgatccacccccttcagcttcccaatttatcacttctttggaggccaacaaagtgctgggattacaggcgtgagcccccacgcctggccaagaataaagcttttaatctttcccctcccctgatctctttgctttctgaaataatctcctcacaaggaggtgaaacattgagtggccagcctggccttgctgttgcttctgtatatcccagcctgtcactcttaggagcacgatgaagatctataagtatctctactttggtccagctacacctccccttgaggaatatagattggaaagggtacagaatatgtttcctcattggtaatgttaaccttttatttcttctgaataatttaatatttgatgtgaaaggctattttttgaagtatcacataatgaaacaacagccctgaacaatatagacattagaagcatttttttcttttaccttactacatgcgttaccaaggaaacaaaagaaattggaaaacaaagaaaaccaaaggagatgtagcaatattgggggttataataactttgtgaaaaagtttcttgcagaggtaagttcagttaaggcacctaaaagcatcttgacaactgataactcacactgcatggtggatacaaaatgtccaatgaaattcccaagattttttaaagcaaatggtgtctgtttctcaccaaggatgcaaatccaaactgttatccaagtcttgttcatagtgctttctaaatatctccagaatgcattgatctttattatttcttgatctctgttgcgctttctcaagccttcacgacagtgtatgtcttccctggattactgtgatgatctcctactagactccctgccctcaatcatgcctctgtaatctgtagtgtgcatggttgtcagcaactctgttcatggccaccatacttaaatttttaaatttctcatgtttcagaataaggaaccctttaacttgacatattaggaagacgcttcatgacctaattcctatgtaatctttccaacatcatctctcacggctgtcctgccttatactagatgtgtcaaatgatgcaattacttcatttgtttatctacttagcaaatattgactaagcattcaacattgtcaggcactgtttaagtgttgcaatataatggtaatactttcagtttctagaataagtcctgggccttatctcttatctctgggcctgtgcatatgtttttctctctcccgggaactctcctcttccttgaaagtataaattctgctaagtgcgctactgccttacttctggtaaaccttctctattacctaggctgaattaggtgacttgctgggtcccctcaaaatacccttctctctcatgcatttatcatgctacacctttcacttctctgtctgctccactagagtataaacttcttaaggcaatatgcctttttcatttttgtatttccaagactgtgccttgcatattatagatgttatttatgggatatcctctgaaaaatctccaagtgagtcctaagatcctagacattgcctagtaataatttttccttcatgaggtagcagatggatctaatctattttttattttattattattattattattattttgagacagagtctcgctctgttgcccaggctggagtgcagtggcacgatctccgctcactgcaagctccgcctcccgggttcacgccattctcctgcctcagcctcccaagtagttgggactacaggcgcctgctaccacacccggctaattttttgtatttttagtaaagatggggtttcaccatgttagccaggatggtctcgatctcctgacctcatgatccgcccgccttggactcccaaagtgctgggattacaagcgtgagccaccgcgcccggtatttttttattgtttttaaagtgacttatgcaaaggtggctatgcctttttataaaagattagcacaaagggagaataataacatttgcaaattatttgcttgaagcttttatttagaaatctgttacatgtccttttttgatatatatatatatatatatatatatatatatatatatatctctatagatctgtagctagattagggagaaatttgggcctaaatttgaacttttatacaccaattaaagcaagtagaatttgtaatatatttcaccacaggccacaatttctgccctggagaaggggtcagatcgtggtctccatctaggggagcagttacctgatagtcacataaactgcaggtcaggcccctctgtggtctgcccctgttcaggttggatttccaagaaaacaggctctaaggagaaggtttgaatatggagatttatttaggaaggctcttgggatccatccttggggtgggagtgaacagatggggatagagcggagtaaaaaaatacagaattgggtggagggagagaatgaataacaacgctgccataataaacacctcaactaatcctatggggaagactggggctgggatgaccccagctttgagaggcaaagggggctgtgcctttatgctcctgcacagaccagtctcccaaccctacccaactgcaacttgatgaatgagggccctttcttcaactgtggtcaattcccaagaagggaatcagatgagtactgggggagtgctatagtttgagtgtacgtgtccctccaaaattcatatgttgaaacctaatcaccaaggtgatggtattaggaggtggggactctgggaggtgattaggtcatgggggctccaggtttgtgaatggaattaatgcccttacacaagagacttcagagatctgcttcccctttcatctccttcatcccttccaccatatggggaaacagagttcatccagtcctccatgttaggatgcagcaaccaggtataatcttggaagcagagacagaccctcaccagacacagtctcctgggaccttgatcttggaccttccagcctctaaaactgtaagcaataattttctgttatttataaattacccagtgtaaagtattttgttgcagtagcaggaatggcctaagacatgtagtgagtgtttcagttctgaaactgcaagtagagatcctggttgtggactctaagttcctaaacctcctcatcacttattgggaaagtcagttttggggctcaggaccattaggaaaattcaagattcctgcctcattcaaatggagggctaaatgcagggtaggaatagcaagaaggtattttctttcaagcccatttccctcttctttcaggctgttaaaacatgttcacttgttcacctgctagtggccattggctcagggaaagtgaatcagatcccttgttcaaggggataaatttagttactcttagccaatcatggtgattctattctgcttttcagagactggtttaacaagagtcatgtgatctttctggtcaatgaaagataaggggaagccagcctggagttgcttcagaaaggctgctcttaaacagaaacatatttgaagaaacagtaactttattctgactctttatgtgtgtggcggaggaagtgatgcctagagctactacaggcacttaggccatgaggagaaccagtgtaagtcagcaagccaagatgctaaagacagcagaataagaaaatggcaagaatcttgtccttgatgctgttgagctactgaattaaccagggctgcaactccctgtattagtaaggattctccagaggaacagaaccaatagaatgtatatataagtatataataaggaattagctcatgcagttacagaggctgacaaattccaatatctgcagttggcaagctggagactcaggagaactgacggtgtagtctaacggctagcaggcccaagaaccaggaaaagctgattaaagttcaaaggcgggaaaaaaaaacccaatgtcccaacttgaaggcatttaggcaggaggaattccctcttatttatgagactgtcagcctttttgttctatttaggctatcaattgttttgatgaggcccacaacattagaaagggcagtgtgctttgctcagtctatcaatttcaacgttaaactcatccagtataatgtttgatcaactatctgggtatgccatggttcagtcaacttgacacataaagttaaccaatcgtcaaaaccccctacttttggtttcttgataaataaaataatatttatcttctgttttagtggaataaaggtatggaaaacgctttgatcagtttctgtcttttgttgatctggaattgcagtatcattgtgattaaagaaactaaaatacagtgtaattaggggatcacatccaaattttgcaaaccctttggtaatgtttagaatatatttgattaattcattttcaattcaacaaacacctgttaaatactaactatatgtcagctaggtacatgttatatgtcaatgaaaaaaaaaagaaaaaattccccttgtggggctgacatctagcatataaacaaatggtcaattttaatatagttttgggtttatttaagcttattacagaataaaaaaatagtgccccaaactgaccactcttgcatagccatgcccagcagccaatactacataatgtcaacctacaacacagcaccatcaagttgttactcaaatgagacctaggcttgacgggatgttaggaggtccatttctatcaatcagagtctggagttcatccatcgccctaagcctgctattgagggagccctatgtaaacatttatgtggccaccaataaatagtaagcccctcaatcccaaccctaacctcactgtgtttctagattcttgcctctgttctttgtttgcactttattctttgctggtaacggattctagccctgaactccagccaaattgtctgggcctacgaattgactagtcttgccaacctcttctctctgggggatctggatcctatcccaattttctcccctctgcagcccactggctaaggccctattacaacccagacaacctctcccattccgaacataaaactgtcatctgttggataataacatttcccacataaccagttcctggtgccatgctcccacctggcttgagatggtgactgtcaccattaatctggtttggattcaggtttggtatgtcctgttagatgctgagacttgggggagcttatagtcatatacctcagacctcccctatccccaccagtcttggcttacttctctctctcctacagatctacagctggggttctcttctggctctcctgccaaggccaatcagatcgcaatacaaaaaagtaacactttccagcattctgtagagtctgattttctaaacagttctttagattttaatgcatctcaataatagttataagtaacattttatttttttctgtggcagattaggcctcctgcaaaatagtcattttcaaaaattgtctaagattcagatgccgcacccaatgtttatgctttttgcagcaatatggtcctaattcaacatcatgcagcgtgcaaatcagtgtttcttctaacttcaacagtgataaatatttattaagcctccactatgttcatggaactataccaggtgctgctataactatttttcctttccaggaaaaataaattcaaatatggaataaaaagcccaaactcatgaaactggactgactttgcttcttaaaaattcaacatgctgcagctgcatgcttaaacctggttcaaacaggatgatgaaataaaacattattattgtgggaatataacactgtctaaataaatagccaacatgaaaactgtctctaaaacccatagcatctgtatgtgcagactgtaagtaagttatataattcctccactattctgtaacatggccaattcagaatgtcttaccattaatcttgaagacatttaaagatgttcacttttctaactcttccctttgaaaatatatttgaaccttatttgcaataaaaatctcataatattgtattactttttgatgtgtcatttctgttaaatggtgcctggaataaatcagctttgacttttcagattacatgtgttgttccagagttttagtagttacaacatacatttacattttctaatgtcctcactataatgaagataaacacaggggtaatttttctcatgtcatgtgtatataggataagattaccaggccaacagtgtcactatcagatttctttcagaaagtgtttaatgttgaattttaatcacatgcttgaacaactaggactttttgggttttatttttcaaatatgtgttagtaagaaaacagactgaaatgtggaatgtaccagataaatctctttggtgattttacatatctgtatgatcatgtttgacttagaaataccaatcttttgatcttacacttcaaatgttacatctgtgaacataaaaatctatatggctataactttccaggaagaaatcttgctcaagtaactaataaatgatccaagttttagataattctgacataattccaacatatttcctacagtattttgctttagaagactttctgacccagatatttatggctaaagtccatattttatagatcaaatgataattaccttgtagaggaaagcatttgtttttgaatagtgccaggagcaagtaagtgtaactaatattacacgatagatatttctgcagataagtgagcttaactctcgtggttaaaacttatggttaaatttccacagattagtaaaagttctcagttttattaacaattctccattttcattaaaagccctactttcctgatagttaggctgatgagaagttagttcagagggctgctcattcccatattcatcactttttattcagtaatgttattttatgaataataattttcttatttgttgaggcgtatatcatgatgtttagatgtacattactatttgtccaatgcaactaattagttaaataggaatgagttgtaatgatcagaggtaatcccagaaaatattttttcaagtttacaaacttataactttataactttacaagttataaagagaccttcataacagttaattaaatcaaagaatcctttagttggaccataagcactaacagtcggcattccgtgaatatttgttatatgtttggtattttgctaagcacttcattttttttaagtgtcatttaattttcacatgaaccctatgaaatatgtatcattattagtcttatttaaatgttgctgaagctgatgcttcaaggaaaagtatcatgcttaaggacgaacagctaccaggtggggaaccggggacctgaactgggtaatctaacttaacttctgcttcagtatcattttagttatatctttcttgtacaagtatgtctcatcttccctgttaactcttcattgataggaaagaccatctttttttaatctttatgttccattacttgccttgggcacagtagagacctataaatgtttggtgctcacatttaataaaaatgtagtaataatagcactatgatatatagcaataatttttttttttttactttttaagggttaaatagggtcaacgtgattgactcacttgtttttgcttattgtacttaaacgtctaatatgttagattaactctattattaatgatttggccacgtaaagtcaacggctattctgaaataaacaaaatggtctgtaaatcccttggtatatttttgctgccaaagagtacaaacattcattcaataaatatttattgagtagaatgaagtgaaatccaagtgcaagaaaacagcaaagaagtaacagaggtgattgagaaaatagaaaacagtagtgagattcagaatgacagcagtggcttccactttagtgtaggtagttgaaaaaagccctaccacaaagttaaacttcagctgagactagacgggtgaggaggacatgaacttggccagtttgaaggtaaagatggatgatgtggctggagtatagtgaaattgtaatttctaccaatctaaaatccaaggcaagctttgcctgagccattccagacttccctggtggatatgaattagatcattccaagtcaaatgttcatgtgttgaaatctaatactaaagatcccttaaaaaatttttagactaatttcaatgaccttccattctggtcacttaggataatgggctaaaatagaaatccctctgaaacattattctctcttactcttatggttttctgtcttctctggatcaacacgaatggtactccctccactgccccaaatattttagccgcaacttggaagcccatggcacatcctgtgtgtattaaaagagggctccattgactacctggtaatgacagatgcttggttctccttggaaaacaattcttctaggtcactcactttctccattcaagactctgacacctgggtcacaatttcatcctctgctaaatcctgttattatcttccctgacttcaaaggttcttccacctctccaactccagtgattttcacatacctttgtcaccccacaaaatactggcaactgtggatatactctgaactttgttattccctacaattgtcctgccctcttacttccagctctctcctcagaccttactctccatagatgtctctctgacaccacagacatctcttatctcatggctctgttaccccagtttatctaccacattgttcttgtttatatccctccccagcttgaaccctataacttattgatggaaccacttttttgtaccaacatccccaaatctctgaaaccttggactttcctatgcatataccttggctgttgaacagtctcagaaaaaggtcacttggtatttgctaggggccaatataatatttaacttagctggagtctaatcaatgcttgactgtcctatgctttgttcttggttagtaattcttgccacccttcccaagaacttctttagattcctgccattcccccttaagatcctttttaactttttcttggtgccttggccttttattctactgacaatattgagatgttgaagaatgaaaactttcaaacacccataccttccctcaaattttgaaccagaatcatccttgactctctcccaccaatctcagtggaagctctcttgccttcttcccaaggccaggccttccagttaggatcttgattaggatactattctgtctgttctccaattttcttatatgccttcaacttttctgcttctcttcatctgtcttttcttaaggcttatggaactcccatttaaaaaatctttgaatttgtgtgcccctttaatgttagccatgtctgtatcagctaacctttatcagctgttttcagaaagaatagtctgcacttgaccaccaccacttcttgaattccccattcattcacctattaaaatcgggcttcctcctctatcctctgcgctgacaatatctggctaaccataattgatcttactatttttaaatccatttattttatttagcatactaacccatttcttgaaaccacctctttatttcattaatgccctcttctgtcatcgaaactctctgcctattgcttccttgtcccctttttctatcttttttctttgcataattcaaaatgctggtactcttggaggtcttttttcagcccattgctcttattactctgcatatgcttcttcagataggggcagacaggatgtggttctcatttaatttcacagtatgtattatcacctataagttgacgcctcagatctgctcagcaacttaggcttccaattggaaggaccataacttagtgaaataaacatactccaattactgaaaattttctacaccaggttcccctgccactctacatacttcctcacatgatggtgccagcatgcattagaaaccaaagccagaccgcttggagtcacttgaaatgccttccctcatgctcacctcatttagtcactacatcttgctgatttcacttctaaatattgctcctctgcttttcctcctactttttagctttgctgttactcctctagttcaggcattcatcttcactcatgttgattattgttttggcctcctttgtctgcctcatcttttctggctttgcactcacagtccatcctccttcttccatcatggctgtccatttaaagggcacatcctcctgtagcagagggatgacaaaaaaaaaggagaaggagaagatgaagaagaaggacaagaagcagaagaagcagaagcagcagcagaagaagcagaagcagaagaagcagcagcagaagaaagaagaggaagaggaggaagaagaggaagaggaggaagaagaggaaaaagaagaggaagaggaggaagaggaagaggaggaggaagaggaagaggaggaggaagaggaggaagaggaagaggaggaaaagaggaagaggaagacgaggaagaagaagaggaagaagaggtagaggaagaagaagaagaagaaagaagaagaaagaagaagaaaagaagaagaaagaagaagaagaagaagaggcaaatcccataacatcactcccctgattgaatccttaatgggtataccttcacctgcccactgctaggtgctgcccactgccaggtgccccatgcttctcttcacaacagttaccacattgattgcagtcctgttgcccagatgtagccagaagcacctcagtggccaacaccttgcctcactcattctacagccttggtacctgggatactacccagcacaccataggcattcaacaaatgttaaactaaacagaatagagttaaatggaatatataaccaaagttaattccatattggagaaaaacaaacatcatggcaagtaattatttggggaacacctaatgcataccagcactgtgttggaacttcacacattttatgctgatttactagacatctgtgttacacagcagggtgaagtggtgtaaggaacatgactttttaaagagaaagatcttgggttacatcctgactgtgccacttcatagctgtgacctcgagagaactacttaacatctaatttttaatatcgcactattcaagggatagcaatgcatttctcacagggtagttgtgcagactaaaagagattaaaaggacctagaaaatgtgtggaggttaaacatgaatgccactggggcttgaacctttctcataatttgacaactgctgagaagggcaggactttttggcatgttaaggtctctgagttcaggaatgaaggggcccccatgagtcctgagtgagacttgctgaggcccagcgatattgtgtgaaacaggatttaagagtttttactttccagaaaccaagggtaacagaagtctctgtattgtaataggaggtcatacctgcttaaatacatagatagtaatttagtatttgctggtgtaaatagtacagtactattggggatacattagaaaccttaggaacatttattaaatgaaatcataatagacaaaacccttcagagtgtgccatctcttttttttgctgtgacgctgacagctcttacactatttcaaagagatttggaacaaattattggtaacaataaagcccctctaaaacttttatatggagatgtttattgcaacattatattcaatagcaaataattacaaataacttatgagatcataaagtaaatgatgagtgatgttataccaatatgataaataaaatattatttatctctacagtaaggcttatgaagactgtaggaaatagaaataaagtgcccaatgtggcatgcatctaattccataattatagctaagaaaatgtaagactatctttggataagggctaataaaaaaaaaataggtataaggtagtatgcaaatatgaatataattaggtttgggcagtaaaatctactgattttttttaattttggaagtttacataattaaaaattttaaattattttaaatgatttatgagcatcagtatcagaatattaaaaatatataaaccaagataaatgctccaagcaagagaaaagcaattactgacttaccaaattattcttctgacatcttaattataaaacctagccataatttattaccagaccctagcttcccattcttataacacagaaaatattattttatgacttacaatcaaggcacaatctcttaaataatctactttagaatcaactataagcaaaagaaaatttatctacagagctatattattagataacctggtttgtagccttgcaatgtgtattcaattgcctttatgtctatttgcctatctcctaaaatactcaaatttcggattttagcctaatacactcacaatcatgagactgattacataactggatttcaaggagaaaaaataacaaagaggaatgaattaattatctgaactttagttatatattagatttcctaaacaagaattacagacaaatttgtttattaagaaaacactgttgagaggaacatgtctttggaattatgaaaaatgatcttccagagtatatggaaagtaaagacattctgaggaaatgtccattatgaaagtccaagtgactatgcttaaaccactataaccgtagatctgattgcttgatgctataattcaattatcttctcactactttacctctcatctgatagtgaaatacagccctattttttcctctagtatttattcaaatatttttccaagtatgacacaatgactttatctcctcagtcagttgtcattcttgaggtatgtagactcatcaaccactaaaccactgtggcgaggaccctggtccatttggccaaaaattctgcccttgttcttcatcctattaaccgtaaatatattaggaatctagctagaagatgtcccaatttattattcattatagctctaacaatattaatgttaactattaagtatgaagatgatttttttttattttccattaagtcatttattgagtcacttacattatgcctgtagtttaggtaggattaatccataatttcttcccaaattcccctgtgattcgattccttgcagaggaccattaaatatatgatgagtggttggaaggttccttcttatcctatggataaaaggctctaaatgtcttaatatatttaattcttcatttaaatcacttctgatgtgtgtttattatataggtaggctctcttgaacatatagtccagtgcaactattaatgctttatttattttttatttatttattttttgagaccaggtctcactgtcgccaagccttgagtgcagtggcaggatcacagctcacggcagcctctatcccccaggatgaagtgatcccctttcttcagcctcccaagtagctgggactacaggtgtatgccaccataccgtgctaatttttgtattttagtagagacagggtttcaccttgcccaggctgatcttgaacttctgagctcaagccatctgcccgcctctgcctcctaaagtgctgcgattgcaggcatgagccaccacatctggccaacactttattgataactgtatgtatgtataagcatttctaggttgtaacaatccattggctctcagtaggcccaccagaggagtactgcacctgcaatgaaaacctgtctcagatttcaatctgcaagtgttttattatgggctgctagtaaattatcccacaagaggtcgctaaagctccggtttttttgatgtgtgatttttctgactttttctccttcctgcaaaggaattgcaaaaaattttctgtttcccggttttctatttcccagtctgttccaacttgacatgaaggtagtcaagaattagggcttagtcatgggcaaggcagcttacttatggaagtttgtagccatctagggttgctcaaatccatcacgtgaacttcagagcatttcttaccacaatttatacttgaaaaggaaatacaaccaggcaccttctgacctcaataactaaactcttttagctgtaatgtagacccctttaaaggcacattaccacttttcaggccctgggttgacattccagttttctgcacataccagaatgatagaatagacatctaaaagaggcctgcactcagtaaatatctccttagagaagatctaataaataaatgctagaggtaccctcattaatggaaaattgctgctacatctatttctttggaggatttttagactcaagcaggcagattcctgtaaagaatttggtttaaaacaaagctgatattttagaaacaatctctattttctccacagaaaacataaatattttttaacaagacatttaaaattgtgttttagagaaaaatcggcttaaaatttgagaatattttcgcccatccttagaagaattttctcttccccttagaaaaatattgcctgaatataaaaagggaatcttaccttgatttctccatctctcaaatctcagaagaaacaatgccacttttagcattcttgactagtaagattattggctatatattttcttagcaagggtcacatgttacatttttaataggttctattacatagggcagaggttataggcaaagacttctctaatgatctttccacttcccttctctacggggaatatttaacttaaaatattgtgatttaatcatatataaagagagaagtgttattgtgaatcaagcatttgaacaattttatgttttcatatgaatatagagtgttaaaattataaataacattttaattatacggatggaaaaacctggaaagatctcaaccctatgaacatgaaggatttatacaagatgattttggaatcatcccttctagtcctaaaatgtaatgactttccttaaattcttatgcttttggactataaaagcccatttctattttaatgagataactttaagtggagggcttttcttatttgaatagctgtcctgttacgatttgggagttaaatatcagataattaaaatttagttgtttacagttactgagatttttgcattatttcctcagcaataattttttatatttacaacctctatgttaatgaacacactatttcatgaagtgcttttgtaaaatgctaacataattctttcctcatgtctttttggaggtaggagactcatatactttttatcagagatgctcatgaacttgaaggcccaaatgaataataatatacagataatgaatttctacttgacttgagccatatcgcaataaagaaggaaaaatgaaacaggctagccaggagggtaggaatagaccagtcacaatgcatcaaaaggcaaatgatagtaatcagaatctcaaagaatcatacaatgagtctttttaaaataccaccaccacctactccactactctgggcttgtgttagctgacaaggcacattggttttcccgtttactcacattaagccctgggtaggcacaaccagagaacatttcaaatatgtatgggttatgaataagtgtgagtcaccgacttttagtccagctgaaactacattgtcagaagagtattaagctggcatttgcaacccacatacttaccttgtgcctgacactgtgttctgtatttaggacaaaggcttttctagtccatgcactcaggtaactcacaatacagttgaagaaaagagataagaacacagacaactacagtattgcatcagtactaaggcatgcatagcacccccacccccagctgtcttacctcttggaaatcaggttgcatcttacaattgatggtatcttgcaaatgccatgtctaggctgctgtcataagcagtcttggtttgtgtgggtgcaaacttggtcatagctgttgatcttgtcttcccttcattgaggtatgtgcactgttgataatgcatgagttgagtgaattgccatttaaaatgctttaaatgttaccttataattcagtattagaaaaaaaattgtggtatgtgcaagaagggctagaaacagtgcagtgggatgtatatttaatgtcactgaggtaaatatttaccattggaaggatgattctcatttcttattttcttgcaaacccataataaaataataattatgggttctaagaaaggaaaatacatgttgaataagttgtgtaaaatgtggtgactatgctatgtgtcaaaggattgtctatcaccttgctacaaccaagtgtggtctctggatcaggtacagtctctgcatcaacattacctgagaagttgttagatttggagcatctcaggcgccacaccagacttacaaaatcagaatcttcattttaaagtccgtaaatggttcatatgacataaaagtctgataaataattatgtcacatgccaagcaattcaatgaaagtcaggaaaaattgcctttgaagagatgaaagaaatttcaaaacaacaaggagttgatgtgaccaattcactcatgcaggactatcattaaggtgtcaaacttcaatatcagaaacttcctgctgagtttgaacagcagttgcctaacttcgtgtgacatgtattttgattgaagaaaaatgaaaacgatcagtttattgaataaaaaatgctaacaaaccatgggctctttgatatgtctcagaatcacactaaaagaaccctttcaatacatataaaataaaaattctaagtgataaggctgtgtaataattttactggcagctttttttgttccttgatgttacataaactaatagtgtgttttataattgatggtggcatagacttgatgaaaaacagtataatacagtgtgataggtgctataataggaagaagtgggagatgctatggagtaaataggtggtggtcatatctcataatcaaggtttgttaccttgagcaaaagtcagtcagatggagatgggaatgaattgaggtgggatgcagggaagttattattccaagaagagagaattacacatgcaaagccatcaaggctgtttgtcaagaagcaggtagagggattgaatcagtttttaggggatgggggagttgggatgctggattgtgttttgccttagctttggtgttacagagcaaaagcaaagggaaatagtacctccacatgtcaaaggaaaatttggtgtccaaaagctcccattcccgctaggagaactgaccttgtgtattagggttctctagagggacagaacgaataggatagatgtatatacatacaggggagtttattaaggagtattaactcacacaatcacagggtgaggtcccacaacaggctgtctgaaaactgaggcgcaagaaagccagtccaaatcccaaagctgaagaaatttgactctgatatttgagggcaggaagcatccagcacagaagaaagatggaggctgggaggctaggccagtctagtctcttcacgttcttctgtctgcttttattctagctgcactggcagctgattagattgtgcccacccagattgagggtgggtctgcctttcccagtccactgactcaaatgttaatctcctttggcaacaacctcacagacacacccgggaacaatactttgcatccctcaatccaatcaagttgacactcaatattaaccatcacaccttgtctgggatcagttttgtgtagaattaggttcacggataaagttagctttgttctcttccagtattttcttgaatgaggatggtttccacttaaggaataaagacattagttttgatggctaagaatggagttttcactcaatcctgtctgcacattgccatcaccccaagtaatgccttagccacactcacagaagtttgattaacttgctatggagaagcatgagcattggtattttttatccattgtctccatgatactactgtgcagtttatttaaaaaaatgggcttatggtcagggagggttagggcagatgaacagctggtcagcagaaaacaggaactgcagcacctataaggctacaaatgaagcaaagcatcagtcaaacacttggcctcttaggggaaaccatttatttgggcagatatggtagggaaatgcgggataaatttctgccatcatatgataagccctaggatttaccaaacaccttggatcatcttggaatcctctcattctaagataacagatctctcttctggcctcctatgggtgtttggatataaaagacagatacacaactttcacatccaggccctcagatacacatttcccagggtagccctgaggtggtgctgctgtacttgtggtcacatcttggtttgaaaacgctggtagagagagtggaacttttcccttcttttcacaaagagtatggggcttttgcaaggccaaaaatagaaaaaaaaagcctaaagttggtgcctacatgtttgtgtggagcatttaagctcaaacagggcatatatatgttgggtaagaaagtggatattcatccataatgacagtatactggtgatatctctgctatgtcttgacataaataggattcctatagttttaccttgctcagttgcaggagtgggaaaggcagctgagtggggaaactgagtcaatatatacaatgttaacagtagacttttgagccaaaggatggggtggacacattcaagaatgaaaggaatagtgggtttgcaaccgtagaggctgagagcaacattaagtaacaagtcacagacagcactgttctctcaactccctctgtgcagtgctagtgtatatgagtgggggtcccctgataatgtctactcacacaggagccagcttgagtcagtggacagctgggctgaccctacctgcatttgtacttcaaagctatgtgatactttagtgtattataggctgcacttggaggtgtgttgttttgaagacagatttgtggcacaaccagtggaatattctctgcccaagagtggcggctgaggcatctagcttattaaaaaggcctccaaactggtctccctgcctccacccttgcccctcacaactctactctcaacaaaacaatagaaatgatcacttgagaatcaaactctgtcttctctactcaaaaacccttctatggctcctctactcaggctgaaagtcaaggtcagtaccatggcctctaaggccctttgtgatttgtgtcccctcccctactcctctgacttcatctcctcttactggtccacacttctgccccagggcctttgcatttgcttgtctttctgcttaaaatactcttccctatatattttggggagctcattcttcttctcctttaaatctttgtttgagtgtcatctttgcagaaaggctttccttgaccaccgatttcgatttaaagtgacatctgactgagccagaaagaaatagattccctgaatagataaataatgagctctgaaattgaatcagtaataaatagcctaccaactaaaaaagcctcaggatctcatggattcatagtagcattctaccagatacataaagaagagctggtattattcttacagaaactattccaaaaaattgaggagggacttcttcccaactcattctatgaggccagcatcatcttgataccaaaatttggcagagacacaacaaaaaagaaaacttcaagccaatatccttgatgaacattgatggaaaaattctcaacaaagtacttgcaaaccgaatccagcagcacctgaaaaggttaatccaccatgatcaagtaggcttcatctctgggagacagtgttggttcatgaataaatgtgattcatcacataaacagaactaaagacaaaaactacatgattatctcaatagatgtggaaaagacttttgaaataattcaacatcccttcaagttaacaagtctcaaaaactaggtattggaggagcatgtttcaaaataataagagccatctatgacaaacccacaacaaacatcatagtgaacaggcaaaagctagaagcattccccttgaaaactggcacaagacaagaatgccttttctcaccactgctattcaacatagtattggaagtcctagtcagagcaatcaggcaagagaaagaaatgaagggcattcgaatagaaagagaattcaaagtatctctgtttgcagaaggtatgattctatatctagaaaactccatagtctcagcccaaaagctccttcagctgaaaaacaacttcaacaaagttgcaggatacaaaatcaatgtacaagaatcactagcattcctacacaccaacatcaaccaaactgagactcaaatcagaaaggcaatccaattcacaattgccacacatacaaaataaaatacctaggaacacagataagcagggaagtaaaagatctctacaatgagaactacaaaacactgctcaaataaatcagagaagacacaaacaaatgtaaaaacatcccatgctcatgggtaggaagaagcaatatctctaaaatggctatactgcccaaagcaatttccagattcaatgttattcctatcaaactaccaacttcatttttcacaaggctaaacaaaattatttaaaaatttatgtggaaccaaaaaaagagcccgaatagccaaggcaatcctaggcaaaaagaacaatgcaggaggcgtcatgttacccgacttcaaactattctacaaggctacagtgaccaaaacagcatggtactggtacaaaagcaggcaaatagaccaatggaacagaatggagaccccagaaataaggctgcatatctatgaccaactgatcttcgacaaaactgataaaaataagcaatggggaaaagactcccttttcaataaatggtgctgggataactggctagccatatgcagaagattgaagctggacctcttccttataccctaaaatcaattcaaaatggattaaagacttaaatgtaaaacctcaaactataaaaaccctggaagacaacctagacaatactatcctggacctaggaatgggcgaagatttcacaacaaagacaccaaaagcaattgcaacaaaagcaaaagttgacaagtgggatctaattaggtcaaagaacttctgcacagcaaaagaaactatcatcaaagtaaacagacaagctacagaatgggagaaaatatttacaaactatgcatctgagaaaggtctaatatccagcatctataaggaacttaaacacatttacaagagaaaaaacaaccctatcaaaaagtgggcaaaggacgtgaccactttcaaaaagaagacatgcatatgggcaagaagcatatgagaaaaagctcaatatcactgattattagagaaaagcaatgaaaaccacaataagataccatctcacatcagtcagaatggctattattaaaaagtcaaaaaataacagatgcgggggaggttgtggagaaaagggaatactttattacactgttggtgggagtgtaaattagttcaaccattgtggaaggcagtatggcatttcctcaaagagttaaaagcagaactaccatttgacccagtaatcccattactgggtatatacccagaggaatataaatcattctaccataaagacacatgcacgcaaatgtttattgtctcacaataccaaagacatggaataaacctaagtgcccatcagtgactgactggataaaggaaatgtggcacatacgcaccatggaatattatgcagccataaaaaagaatgagatcatgtcttttgtgggaacatggatggagctggagactgtcatcgttagcaaactaacacaggaacaggaaaccaaatactgcatattctcacttataactgggagctatatgataagaacttatgaacacacagaaggaaacaacagacactggggtctacttgaagggggagggtaggaggaggaagagaagaagaaaagataactattgggtactctgtttaatacctgggtggtgtaataatatgtacaacaaacccctatgacatatgtatatctatgtaacaaaccttcacatataccccaaaactaaaataaaaattaaaaaaattaaaaaaattaaaattcatgaaaaaaaaagtgacacccaacacttcctaacccatgtcactgctttatttttctattttcttcattcattcattcataagttccatgagagcagggctttttctcttttgttttctgctacaggaacagtaagtgcctagaacaataagtggtgattaagaactagctccttgctgaataaatgaaagaatatgtgtattatcccaaaccataatgtttcttggtgtcagtaacactgggagtgggcactgaccacgtggtccacatgcagaatatgcacagctatcctcgctggtgaccttcttgctttgtggatgtcaaagaaagtagacagctatatggactctgccacctggataactctagaggtgagtggtaggggttatgaacagcactgaggagctgggagtggctgtttgttgggtttctagcttcaggacaagttctatgagtttcctgagccctcatgatctaaaactatgaagcatgatggtgctggggtgaatactcattgtgttgcttgctcggtactcactatcctaactttgttctgaaggacccatttctccctcactctgtgtgtttcaagtaaaatatgtactgaagaaaatgccacctatttttataaatactgtgaactaagaatgatttttatatttttaagtggcttcaacaaaaatcaaaataataatatctaaatttcagtgcccataaagttttattgtaacttagccatgctaatccatttatgcatggctgcttttgctctacaatggtggaggtcagtagttgtgacagagaccatgtggcctgcaaagccataaatatttactatctggtcctctatggcaaaagtttgccagcctccacctcagactgtcgctgtggttagagtcctatgatcacagtgggtggttcagcacaagacccaggtttaaacgtctggtcttttctttgaactacttgggaagctagctctagctagctagctagctagctagctcttctgctgcctcaggtgagaaactgaggatgtcaggaagcatcaggcagcccctaaggatgaggtcgtaatcaagcttgattgaaaccattccaactctagaattttcagctgtgccaatcaatacattttctttaatcttaaattagctagcattttaagatctttgttgcttacagccaaagaaacttaactgataaagtcatttggaagaaatcctactccaggtatacagggaacagaattaatgagttcccaagatgattgccttatggtggcaacagcagttgcctggcagaagataggaaatctgtcttaatagtgccttctaggacccaaatttgtcctgctctggtagaaatcctagaagatcaggaatacaggagatgcaattagtgtttaggatcttcatttaacagcacacatctgtgtcttcccttggcataaatactgggagaatgcagtactcaggatttttatatcctcttattggaattacccacataatatatgatttattgcctatagacttctcaatttctatgtacacaatagcagcactaccatattttttaattcaaatgaaatgcatgaagatgtttgggtagaagtaatagaaaagtttagtaatgaataatgtttcattattctgtctattttctgaacatcagtcattatcaaatatagactcataatcaaataataatacatacacctacaatattttgattatgatgtttttagaaacatacatctcttttccctcctactgattaatctccttgctgtttaagcagcaaagctgctttccactcagtatctcagggaaaggatatgacatggtagacaacagaaaacaaatgaaacaactcccccacactccccaaattcaggaaacttcctggcaaaaagctcactcctttaggacaatagagagtctctgggtagagccaaattatataagagaaacatcaagggtgactgttgctttcgccttctggagaggaaaagattcccaggggtttatatagaaaaggaaggggaaaagagggaacagggaggatgtggtggcagtgcgtttggatgggtttcaaagagggagccccagttccatcaaggaccttggagcccctggaggcttctccctcgggttctgtggggccaaggagaggcgtcccctcaatcccacctggattccctgctggatcagccctagaaggaagcttcctggggctgctcccacttctgcttaagtgtggctacaccgtggagggtgggtccttaggaatgtggcaagggcagcaagattgagggggccatagtggtgcgggcatgtggagggggcacaggctttggcccgcgggcctgtgttcctatccctccctctgtcgttccctgtgaccaatgggcggagggcccattcttggcagaaacccagggaagtggcaaaattcccagacagtgttgtgagagcagtagaatgttcacaacctcctacccttgccctagcatcagggtttgacagaaaaattagattgaatgaaataaaaatatttctcacccacttgcgttcatggatggagattgatgaccttctaggtcagacacatttgtttccattagtgtggaaaatcaagagttgacttcactcctcagttcttccaagggtgacagttaaattttggctgcacaccagcagccaatggcatgcaagtgttagagcaggttatctgcatttcatgtgctggattttgcttcactgcaatgcactattgttcattttgaagaactgctttttcttcatttgattatgaagtccattcttcactgagaaagggtgaatcactgggtttcattatggagctcttgaagttcagggagagcgattttcatactaagttcattttctttaacatataaccagtgaaataatagaacaaaaatacatttatcttttataattgtttccctcctctaagacataacagtattaacataacagctatactgcataattcttcttcaaccaaagaacaagaagattaatctattctatttatttataaaatctcctgatatttctgatactggtttttcccgtcattcacctggtggaaaaagcaaggtggggaaataaacgatggtgacagctttttgctggcaatgcagaatgaggcccttgatgttattgtggcccaagggaaagtgtgagtactatattcatcagcagttctcaatcgggctattttgcacattaggggctatttggcaattttgggagatatttttgattgtcaaaactggtgaggtgggtaaggtggaaggtatgctactggcatctagtgagaagcgagatgaagctaaacatcctacaatgcagaagatagccccagcccctggcaaatagttatctggcccaaaatgtcaataataattccaaggttgagagactctgatataaagtaatcaggaaaggaggaaagatctgagtatgttaggatgattggcagggtttttgcagactgagaagagccatatggacatttgttgaaaaagggggaaagagagacacctgaagagttggataattcttttatactatgtaaggcatattttaaagggctaccgtttttagagggtacgttcttaccaactttttaaggagaggataaaattctgtgaaatcaatattatggttattaaaagcacaaaaggaccataattgtttcatgatttgtcttgctaatttcacatactatgatgttttatgtgctgagtggagataaatgtgtaaacaaaaatacgaaggtgacaaagcatggtatatttctacctggctaggttgtataggccagtgaatgtctaggggaagggtggtcctggagccaggtgagagagatcttgaatggaaagttacagagtttgaatcaattcattagaaatggaggcaggtgtattatagggttctccaggtaaacagaatcaatagggtggggagggagggaaagagagagagagagagagagagatgagagagatttagttttcaattgagggagctggcaagtcctagatttgtatgacgggcaagctggagattcaggtcagagttgatattgcaatcttaagtctggaaactcttctgcatctggaggcagaattctttctgagggcagtgagaggcaatctattccatacttctcacccagcttcttgttgtttactgatcatttttggcgttccttgtagaaacatcactcttatctctgccttcatctcatatgatgttttccctctgtggttgtctgtgtataaatttccccatttttttctatagacaccagttatattggattagggctcaccccagtgacctcatgttaactaattatagcttccacagccttatttccaaataatgtcacattatgaaatactgagggtaaggacttcaacatatgaatatgtcagaggcagacagtttcacctgtaacagggggtttgcatagagcagtgacattttctgaattgttccatgctggcaacattgcccagttttcttctcagggacatcagttataggaaaatgctatagtgaaggcaaatgggacagaatcttaaaatatttgtgaatctttgttttttcttgttctaatgataatgtaaatgtagaaaacactaacacattgtaaaacacagaaagcaaaataggtattatactgctcagttatgatactgctcataacccaatttatcagtaatagtatgtctatatttaaatatctaaaaggactattttttaaaaaatatgggtcttgctactttgcccaggctagagtgccgtttggctattcacaggtgcaatcatagttcactgcagccttgaactcctggcctcaaacaatccccccacctcagcctctcagcctcacgcgcagctggggctacaggtacgctccactgagcccagctatggaatatctatttttaataaaaatgtgaatcatagcatacgtactgttctgttattatcccttgttttcttttggacattttggacaccttttcgtgtcagaacataaagacctactaattcttttttatttactgcctagtatttcattgaatgaatgtgctatatctgtttaaccaatcccttattgagtgccatttgggttatttctaaatttttacttttacaagaaatattacagtgaatgtcattgaacatatatctttgtacagtaagtaattttttttgctgggtatttttttttttgctgggtatatttttagggatagaattgttgagccaaaaggtgtgatcattttaaactataacagacatttcaaatgcaaaaatgctgcatcaaatttttttccctcccactaaaaacatatgaattagattagtaattcctacatagaaagaattaaatagactacactgatagtgtatttaatgacactatgccagcacaataattcctgtaataatcaaagaatagttaccattgttttattaatatacacttatttgtcctccatagagctcttgttaataaatcttagcttattgctaagatttgggacttcttccagatggagtttatgattaaatgctaatcacattgttaccgaagtgttcagctttattcattatttgtttgatgtttgccataaaaattacagcccttataacccattattttggtttcaacttctcaaaataaattgaaatatatgttaaaaacttaatgtttgattactgtttaaaatgctaaaaaatatgatccaaagtatcagtgcttagaactagaaaacccaaatagctttaatcctttttgggggctttcttttcacccccgtgatgtgtgggtgtgtcaaacgtggattccttcctgttgttctgtttgctggagcaaagaatcatgtcttgataaattcacaagactagtgaatttcatctagtgtaatattgaggagtccagatcatggagaaggtgtggctaggactggtaccccccaaatactgtcatctccaatcacaattctggaaaacagtttgatataagaacatcaatgaaatggtaatttattacaccagtagagtggagctcagctatggagacacaaagcctggtgagacttggaaatcctgggcttaggccgtcagtttctggggtctgttaagaggatgcagagtgccagccacagagctgagtgtcagagaagggctatagaataggggaggaggaatagaagagccacttggtgttcttgttgtaggaggcacattaacacatcagaaatgttccaacagagaccaagctaacaaactggagaccatgaaatgcagatagtctctggagactacacatccaatgtctgaattttctaatttacttttcaaggcaaagtcattgataccatgtttttctccacaatatttttgcctgtaccaaccaagagataacatacggcacttcctaaaacaatacgattgccttctggattttcttccaaatcagtgatacctgttctccaagttttgatgatgacactgtctttagcttatcagaaggtggccatggaagatgctcagtcaacgagcaagattcatatttcttcctgaaatggttttgaaatagttgttgcgggaaatgtgaagggattgtggtcatgcagtcatgtcaccagaaataaccaaatttatccgcagctgttgtcagatacaatcaatagcaagataagcctcaatttcaaagatattaaaatgtgaaacttagaattgaatgaattattaaaatgtgaatcttagaactgaatgaaatatagtaatgtgaaaaaatttaaaatcgaatagagcttttttttaaaaacatggatcttgctgtgttgctcaggctagagtgcagtggctattcacaggtgcaattatagttcactgcagccttgagatggcttcattaattatttcctttaatcattcagcaaatattcactgaacatctttatgtacaagaccttgtggtaaaacttgccacccatttttatttgttgcttatgcctccttctaggtttcttaattagcttagctaatagtttatgaaatgtattttttattccaaagactgaactcttctatttctctattagttctgctattttctatttcattatttttgttttaattcttgtttcctttcttttatgtttttttacaactgtttaatttaaatgtcttataaacttagttgtaatcttaattatttagatatataagtatttaaatacatacatttctctctgctctagccatatcctattatttctattatgtggtatttgaactactggtatttcctagatgccttactattttgatttagagtttttcctttgatgcaaaagttgtgttagagagaaattaaacttacatgtagcagtatattttgtttttctaattttgtgattaatttctatatttgttgtagtagaggatgttatctacatgatttttactttcaggaatttattcttttttttgtggtttgacatatggtcaattttgaatatgtttaatgtgtaattgaaaagtgcgttgagtttgatttaaattaatgtatctatcttattgattaggtcatttggctcattattttttcttctacttaatctgtatcatgaagagatgacttcgtctcccatatttacttgtgtttctgtgtttctttttgtatttcttgtttctatgaatttttttattatttgtgcacaaatactcataactgttagatttttattgtgggttgtaggaattgttccaaagtacctctctttgtcatattttgcactttgtgagttgaattccacattgtctgatatcactatcttgaccctgcttcattttgtatttgccaggtaggtctttattgattctttcaactttcccatgccgctttgtttcaaacttagcttttcagtacaccatgttttactctgtgatctctttttcttttattacctttctatttattttctctaaaagatatagtctttggtttctaataggtatttttaatagcataacatagctacacagagcattatttagactgtacatgagttacttgttttaaacaacaattatcccttcttcccctgacccctcaccctccctcacaaccaccttcctatttggatgagtcctctgtacatggcatggccaatggagtccacagactgacctgtcactgccatggccacagcagttctacattcaaatggattcatgttcactgcctccacttttgccatagcttcttcttccttttattgaatggttgaagtttgtttctttaagaagtcttcacgggaccatagttcttaaattcatccatgtttgaaaatgtctactgtttgtctctttatgcctggagaacactttatgcctggggaaaactttatgcctggagaactataaaaatctctgaagtgcataatcatttccctgaagacttgacagaaagttgaaatttatctgatttttttcccttatagatgaccagattcttcctttatctttgaaattttatatattcaccagaaaagatacattaccagtttgatcgctttcatgcatttttgctgaaacatcatgtgacatttgaatttgtagattcaaatatttatttaaaaatgatttttaagttatatttttgagtacctttctgggtcttattgttttctgtttcatggaccctaaataaatgtatacttcatttcttttgtctgtcttccttccatagctttactttcctctctagtccttttaaactcttttggtttggcacagtattctcaagcttgttcttcaggtccttgaatttgttctatctgtcctcctttccgtgatatctaaatgtgacattcatttttgtgatggtcttattttccccttccatttccacctaagttctagcatttacagaggtggttctttcattaagttctcctatccaggaggacagtttaaagttttcatcagcttcatgacaatacatttgaggtatgtgttgtgggcttgtatctatttttggaagaggttgtatttcttttcttttttaagagtgtttttactttgatctcatgctttaaaaaatatctgatctttgaatgagagaaagtctttttctcagctcttagttgaactatagaatagtgctattttaccctaatctgtctctaatatgattatttacaatggttcaaatgcattttcagcagaaaaattgtttttttgaataagttccaaacttgctttccttattaaaagaagctagttggaacttgggtctgtgtgcttaatttttaagcaaaatggagcttttgctcaaaatggagcttcactgctttcattggttataaaattgaacctcatgggaagtgtaaacataaaaagcataaagaagaaagcaagaatcacccataatttttaccacttagagataatcaccatcattttgatgtatataagactgtaatttttaaagtatgtaaatttatgtgacacatgtttgtatatatagtgtgtatacacacatacacagataaatggcagatatttgcatgtgtgtgtatacacacacattcatacatatatgtgtacttagtatatatatacacatacatgtgctcatactatacatacgtaataaagtgatctaactttgctttttccctaaaggtcagagctgatgttctcaaaccttgcacagaggtcagccctagggcacaagagcaaattcatagggtgggtgccatgggaattgaaaaaagttttttctttattttctctaattctgatcctgaccctgaccccaaaccctaaccttaaccctaaccctaacccctggaattttaaaattattgagaaaaatatagtgaatgctagatgaccagttagtgggtgcagcgcaccagcatggcacatgtatacatatgtaactaacctgtgcaatgtgcacatgtaccctaaaacttaaagtataataaaacaaacaaacaaacaaacaaaaatatagtgacattgatatcttttagatactttttgagatactaaatggaagtagttcattttatagttctgtctttagattgagctatgttcctttcaatgatgttatctttgcaaatctgagttgatgaaattaaaagcaagtaaataccctgtgaaaattatctgggaacaggaaacgagggtggcagtattcattctaagtccaaggcttgagaaattgtgcagtgcccaacattaaacagatcccattaataagtaatttggttaagaatgacataaaaataatatttcaatttatgtgtattatttctttcaagcatggaaatctgtgcccggcaaaaccctcaatcaaatatatggcataaaaaagatatttttagacccctaagatcttaaaacagttacctctcttctaattggtctaaaaactttctcaggaacctgttggagaatgtactccttggaaataaggaagaaagaggatccagggaacaggagtttcaccacagaggagcaggaaagggaattcccagtatgatggcaagttgctaaattaaatgttttgcccattattttttactgggctgttggtctttttcttattgacttaaagaactctttattataggagataaacctttgttgtgttgcaaattatttcttgaaatgtttttacctcttgaatttgtctttgagtttcttttttctttgctctacagaaacttaaaatatttatttgatcaaattgattaacgtaaggataattttaactctcagatcctgtgaccctattaagttagatactataacttacagaaactaagccagctgtctgacttcttcggactttagatttgttatctgtaacatgacgagtcttctgctagctatttgtgaagtcccttccaactgtgattattgatcagtattgacttcatgtgatgggaagcttttgacaacaaatttaaattagctcctggaaaaattctagaaacaatcaacaacaggattttagataaaaccatgatattaaacatcataaaaccacaaaatatacagattgaagtggcagaaaaattcagtgactactgctgagacgacatggagaaagaacacttcctcattttgtctgaggcctggtgattcaacggctgtgtgaacggaaggtagggcatcagcaggcctggaaatatcaaactggtctctaccaagcttctcactagcaaaaaggaaagagacgggaacttgttgaaactccccctgcagcatgttttggacacaaacatttcttattgtttttttttcttttttttttctgtgagtgacaactcattcacaaaagagaaaggtgaccagagagctttgaaactcattcacaggctatagggaactttcctcactctctgagctcctccttagctcaggtaggagatggggaaggagtaggtgataaaagggagttcatattgccatgcttttgcaactctttccccttctccctaaattgctaccccatggaactttggttcatctgctgtccttatgtaatgctctgatctggatgcagctttcattagcaatatctgcaaacaggaatgagacattgcatgcatttgttctgaaatgatactaattttaaaaactatctgcaaataaatacaagtgcttctcaaccagtgtacatctttcacattgctttgtccagaacatgatcagtgaaactaaatctctagcctctgcactagactctttttaaatttttcatattttccattgctggttagtatttgttctcacatgtatatagagataaaagcatcacagctatatagcttgtgaagatttcgtttggccctgttgaaaattacacagtcagaaccatttcattagtatcaagcctctgtcaagatgtatggttagaaattgagtaagcttggaaatccgttgtatttgcacacatttgagacatccagtggggcaccagactataaaatagctggcttagcagactaaatggagtaaatgcattaggtttttgcatttagaatctaagagcatttagaatcatcatagatgagttccaaatgagaaaaataatatatatgcatttaaagcaaactaaaacgtattagagaaactctatgtgttagagtaaatattttgatagtcattgtaaagctgttttaataatgattttatatggccacatgatgccaattacttaaacatgctagatatctttcattgtaaaaataatgcaaaaatgttacaaactattcaaatataaggaagaacacagtgtgactaccttaacacaccgttgtgtacatttttctgtccatccttacaggtatttgccttgtgcagattttttacatagttgtagttgtataattcaagcacctttttgcattggctgcatttttacaactttatttataaaggtagaaatagcaacaatctttacatatttgtagtgtaacttgcttaaacattactcttatgttggatattcttttattttctattaaaatatcactactataaatatatattcatatatatacacatagaaaataattttttactcaatttagattatattaataggaagcatgatttcaaagttaaagtgtaacatattttttatggttcttgatacatatagctaaattgcttttggaaatgattgtacatatttagaatgcaattagcaatgtataaaactgccagtttcactgcaccaccatcaaaacatgatttcttcaataaactatttaatagatttaatacttaataataccttcctgggtttttttggttttcttttgttttaaattaatgccttggcagaatagggtcaatgctgctgtggaaatatagtcatggagcaagaaattcaagacttttttttttttttttttggtgtagtttagcaggaaaggtgcagagagtgtgagaaagaagccatttcatctgggtgcgtggtgaagtatagaagggttcctatttaaaaatctagggtttttctcctactttttaaaaatttggcctattctcctatttccttatgactgtgtaaagaaaaaatccccaccacctgccactttaataagaaatgtactattttgttccaaagggcacttgttttgcatgtgtcagctgaagacagaggctcatgtgaagcttaatctggacggaactgtgcagtccctaccaccatcacagctctagagccatggaaagtccaacaactaatttctgggcacagtttactgaggaggaaacttttgattctatagtctgtctttggggactccagtagatttttttgaagtatgtttaataatgtctggtacgtggaagtcctgagacttcaaacagcctcagaccatttggctcttggtcagttagagcaggtgattcaactgcttctgcaataggtagcaggcaggacacaaaaggagctagccaaggacttattgcagttgagacaggaaggagagactgcaacagcctgctaccatgaaaggtgtatgtgtgtgtgtgtgtctgcatgtgagttcattggccggggtagtaatggtgtttaggactacatttgttatctaggtaatgtaggggcaagggaaatgagatagccctgtttttgttttcagtgttttccttcaaggcctgtttttctctctgggttgagaactaggaccattttcctggttactgtttctactacttagggaagtgtagggagaacataccttcctgtgtgtgaattagagcaaaggccaagtctctatgtgtgcatgtgcctgcacatgccagtgttctgcatttgaaataggtctggtgggccattaaaagggacacgggcttgagcgtttttggtcttaaaggtaggggtgacttaagcagttatagcctttgtagaaagagtctatagaaccagacacatcgaaggtctaggagaagaaaaaatggttctcctgggagaacaacattcctgggagatagtttacctactaatgaagatatggctgatcaggcaataagaattgaaggaaacaacccttgatggtgaaattggaaaccacaaggaagagaaaatgattgaagtcatggggatggtgtacttgtcacggaaaagcatgttgaagatgggaagaaatagaaacaaacttagatgtggagacctgagtggaaggagcaagtagagcagaaactcacaaatgtaaggtcagttttacatttgtcactttagaaaatcagaattaaatttatgttttaggaattttaggataaaataaataggcattcttctatcttcttaagagtattgtgagcattatagtaattcagtttccaggtatatgcaccaaagaattgaaagcagggatttgaacagatatttgcacacccatgttcatagcagcattattcacaatagccaaaaggtggaagcaacccaagtgtccactgatagatgaatggataaacaaagtgtggtacatggcatataacccagtcttaaaagagaggaaattctgatacatgctaaaacgtggatgaaccctgaggacattatactgagtgaaataagcaagtcacagaatgataaatactgtatgattccatgtaatcataattatattccatgtaataaatactgtataattccatgcactctaagtaatcaaaattcatagagatagaaaatacaatggtggttgccaaggtccaggggaagggggaataggaaggtagtagtgtttaatagatacagagtctcaggaagattaaaaagttctagagatggaagatggtgatggctgcacagtaatatgaatgtacttaatgccactaaactgtatacttaaaaatcgttaagatggcaaattttttgttatgtgtattttaccacaatgaaaacaagtggagggctcaaaaatatatacatttcataaaattacagtaatctgacaaccacagttttcggaccactagagttcattaatagtgatttaaatttttatagcaattgaaaaaatctgagatctttcacaaacacaagatttagtttagtcctttatagttgttcctaaagttgtctattaaaattacttattaaactccataaacacacaaaatacaaatgtctgggccctgccccagacctattgaatcatactctccagggatagatgccaaacattcacatcttaacaggtgcttcagaggacccttatgcagcaaaaaaatacaagtgcccccccacacccaaattactcttccctctttagacctgggggtaggcctcttggggatcatgcagagaaaagatcttttaaattttatcctttcaacaaatgtatgagaggctagtctggggaaataatacttcttaatcaccttgataatttataaaaatgcataagcattttataaaagggaataagggaggaccagtaataaaagatgtaattattgccatctttggtgagtggaagtttagtgtcaggtatttgatttagaaaaataaagaaatgtgacagtcctaccacttcaagcattgtagaagtatatatatgtctgcgtgtgtgtgtgtgaaatatatattatatatattactattttttccattgcctttcattaaaaaaatttttattttactttaagttctgggatacatgtgcagaatgtgcaggtttattgcataggtatatgtgtgccatggtggtttgctgcacctgtcaacccgtcatctaggttttaagcctcacatgcatcaggtatttgtcctgatgctcttcctctccacctctcccatgacaggccccagtgtttgttgctcccctccctgtgtccatgtgttctcactgttcaactcccacttatgagtgagaacacgtggtgtttgggtttctgttcccgtgttagtttgctgaggatgatggcttccagctttacccatgtccctgcaaaggacatgatctcattcctttttatgactgcatagcattccatggtgtatatgtgccactttttctttatccagtctatcactgatgggtatttgggttggttccatgtctttgctattgtaaatagtgctgcaataaacatacgtgtgcatgtatctttatagtagaatgatttatattcctttgggtatatacccagtaatgggatggctgggtcaaatggtatttctggttctagatccttgaggaatcacactgacttccacaatggttgatctaattcacattcccaccaacagtgtaaaagcgttcctatttttccacagccttgccatcatctgttgtttcttgacattttaataattgccattctgactgatgtgagatggtatctcactgtggttttgatttgcatttctctaaccatcagtgatgttgacctttttttcatatgtttgttggctgcataaatgccttcttttgcgaagtgtctgttcatatcctttgcccactttttgatggggtttttttttttcttgtaaatttgtttaagttccttgtagattctggatattagacctttgtcagatgggtagattgcaaatattttctcccattctgtaggttgcctgctcactctgatgatagtttcttttgctctgcaggagctctttagtttaattagatctcatttgtcaattttagcttttgttggaattgcttttggctttgttgtgatgaaatctttacccatgtctatgtcctgaatagtattgcctaggttttcatctagggtttttatgattttggattttacatttaagtcttcaatccatcttgagttaatttttgtataatgtatgaggaaggggagtccagtttcagttttctgcatatggctagccagttttcccagcaccatttatgaaatagggaatgctttccccattgcttgtttttgtcaggtttgttgaagatcagttggctgtagatgtgtagtgctatttctgaggtctctgttctgtttcattggtctatatgtttgttttggtactagtaacatgctgttttggttactgtagccttgtagtatagtttgaagtcaggtagtgtgatgcctccagctttgttctttctgcttaggattgtcttgactatatgggctctgttttggttccatatgaaatttaaagtagttttttctaattctctgaacaatgtcaatgatagtttaacaagaatagcattgaatgtataaatcactttgggcagtatggccattttcatgatatttattcttcctatccatgaagatagattttttttccatttgtttgtgtcctctcttatttcgttgagcagtggtttgtagttctccttgaaaaggtccttcactccccttgttaggagtattcctaggaattttattctctttgtagcaattgttaacgggagttcattcatgatttggctctctccttgtctattgttggtgtatagaaatgcttgtcatttttgcacattgattttgtatcctgagactttgctgaagttgcttatcagcttaaggagttttggggctgaaatgatgaggttttctaaatatagaatcatatcatctgcaaacagagacaatttgatttcctgtcttcctatttgaatacactttatttctttctcttgcctgatttccctggccagaacttccaatactatgttgaatagcagtggtgagagagggtatccttgccttgtgccggttttcaaagggaatggttccagcttttgcccatttgatatgatattggctgtggtttgtcataaatagttcttattattttgagatatattccatcaatacctagtttattgagagtttttaacatgaagggatgttgaattttattgaaggccatttctgcgtctattgagataatcgtggagtttttgtcattagttctgtttatatgatggattaggtttattgattggtgtatttgaaccagccttgcatcccagggatgaagctgacttaatcgtggtggataagctttttgatgtgctgctggattcagtttttcattattttattgaggatttttacattgatgttcatcagggatattggcgtgaagtttctttttttgttgtgtctctgccaggttttggtatcaggatgatgccagcctcataaaatgggttagggatgagtcccttcttttcaattgttaatggtttcagtagaaatggtaccatctcctctttttacctttggtagaattcagctgtgaatctgtctgttcctgggcttttctggttggtaggctattaattactgcctcaatttcagaacttgttattggcctattaagggattcaacttcttcctggttcagtcttgggagggtgtatgtgtccaggaatttatccatttcttctagatttcctagtttatttgtgtagaggtgtttatagtattctctgatggtaatttgtatttatgtggggtcagtggtgatatcccctttatcattttttattgtgtctatttgattcttctctttcttcttctttgttagtctagctagtggtctatctattttgttaattttttcaaaaagccactcttggattcattggtttttttgaagggtttttgtttgtttgtttgtttctatctccttcagttctgctctgctcttagttatttcttgtcttctgccagcttttggatttgtttgctcttgcttctctaattctttcaattgtgatgttaggatgtcagtttgagatctttctagctttctgatatggtcatttagtgctataaatttctctcttaacccagctttagctgtgtcccagagattctggcacgttttctctttattcttattggtttcaaagaattttctgatttctgccttaatttcattatttacccacgagtcattcaggagcaggttgttcaatttccatgtagttgtgtcgttttgagtgaggttcttaacaggactgtttgagtgaggtcctctcacttttgtgatttcagtatttttgcatttgctggggagtgttttccttccaattacgcggtcaattttagaataagtgccatgtggcactgagaagaatgtatattctgttgatttggggtggagagttctgtagatatctctcaggtccacttgatgcagagctgagatcaagtcctgaatatccttgttagttttctgtcccgttgatttgtctaatattgacggtggggtgttaaagtctcccactcttattgtatgggagtctaagtctctttgtaggtctctgagaatttattttatggatctgggtgctcctgtattgggtgcatatgtatttaggatggttagctcttcctgttgcattgatcccttgaccgttatgtaatgcccttctttgtcttttttgatctttgttggtttaaagactgttttatcagagactagaattgcaacctctgcttttttttttgcttttcatttacttggtaaattttcctccatctgtttattttgagcctaggtatgtctttgcatgtgagatgggtttcttgaatacagcacactaatgggtcttgaactctttatccagtttaccagtctgagtctttcaaatgggccatttagcccatttatatttaaggttaatattgttatgtgtaaatttgatcctgttctcatgatgctagctcgttattctgcacactagttgctgtgatttcttcatagtgtcattgggctttatattttagtgtgtttttttgcaatggctggtacaagtttctcctttctgtgtttagtgcttctttcaggagctcttgcaaggcaggcctggtggtgacgaaatctctcagcatttgcttgtctgaaaagaattttatttctcctttgcttctgaaacttggtttggctggataggaaattctgagttgaaaattcttttatttaagaatgttgaatattggccctcaatctgttttggcttctagggtttctgctgagagatccgtgctagtgttatgggcttccctttgtaggtgacctggcctttctctctggctgcccttaacatattttccttcattttgactttggagaatctgatgactatgtgtcttggggttgatcttctcatggagtatcttagtggtattctgtttttcctgaaattgattgttggcctgtcttgctaggttgcagaagttctcctggataatattctgaagtgtgttttccaacttggttccattctccctgcctctttcaggtactacaatcaatcacaggttcagtctttttacatagtcccatgtttcttagagattttgtttattccttttcattcttttttctctaatcttgtctgtctgtcttatttcaacaaatggtcttcaatctctgatattctttcttccacttgattgatttggctattgatacttttgtatgtttcataaagttctcatgctgtgtttttcagctctatcaggtcatttatgttcctctctaaactggttattctagttagcagctcctgcaaccttttatcaaggttcttagcttctttctttggattaaaacatgctcctttacctcagtgaagtttgttgttagccaccttctgaagcctacttctgtcaattcatccatctcatcctccatgcagttctgcacccttgctggagaggtattgcaatcatttggaggagaagaggcgctctggcctttttaggttttcagtttttttttgttgttgattctttttttttttttttttttttaagacaaaatctctcactcagttgcccaggctagagtgcagtggcatgatcttggttcactgcaacctctgccttccaggttcaagtgattgtcctgcctctgcctcctgagtagctggaattacagacacatgctatcatgcccggctaattgttttgtatttttagtagagacggggttttgccatgttggccaggctggtctcggactcctgacctcaggtgatccacccacctcagcctaccaaagtgctgggattataggcgtgagccaccttgcctggcctcactgattctttctcatcttcatgagtttgtctagtttcagtctttgaggctgctgacccttggatgaggtttttgtgggaacattttttttggttgatgctgttgttttgctttctgtttgtttgtttttcttccaatagtcaggtccctcttctgtagggctgctgtggcttcctggggttcatttcaggccctattcatctggttcacttccatgcctggagatgtcacttgaggaggctggaggacagcaaagatgggtgcctgctccttcctctgggatctctgacctcaaagggcactgacctgattccagtaggaatgctcctgtacagggtgtctgacaacccttgttggagggtctcactcagttaggtggtatggaatgcaggacccaattaatgaagcactttggctgtcccttggtagggggctggtgtgctgccatgtgggggaaacccactcatctgggcttcctgtattcctcagaactagcaggaggaaacactaagtctgctggttcatggagactatggccacccctcctgctaggggcttaggcccagggagattacggttctgtccctgagcccctggctggagttgttggagttcctgcagtgaggccccacccagtgaggagggatgggtcagggtcagacctgaagaggcactctggctgtagtctgccacagccggtgtgttgggctgtgggggatacctcttgggaccaagccatccagcctccctggctccagcaggggaaaagcatgacctggagctatggagatggctgctgcccttcccttgccctgggggcttagtgtgttaggcagctagcagtcccagtgttggctgccatccctccctcaaggagctcaaatggcttagacagcgggaagccgcagctgtggtgctggccgccccttcccccaataactctgcaggcttaggcagattctagctgagtggctgttgaaaatctatgtggcttcatggttgggaccctagacctgggtggcatgggctcatgagtgggatcttccattgcacagttccatgggaaaagcatggtttcccaggctgagtagcatgcttgctcactgccttcttggctggtgggtgggggctcccctgacccttgtgggtctcaggtaggccgcagaaccacactggtcttcctttctcttggtgggtcatgccagccgcctagtcagtgctgatgacagaacctggatacctcggttgccagcacaggatttgcaggctgttttgtttctttttgatgcaagcctccaattgtggctgcttctagtcatccatcttgggcctgccccccagttgcctttccagacctgtgtagggcagagcctttgggtttatgtatagaaagaatgcaaatgcaaaacattaaatttcaagccagtagataatggttctcaatccttttaactggatgccccagcagatcacagaacagcaacatgagttctagaacaaatgcaaaaggtgctctggtagaggacttcctgccagaacaagttttcaatgacaaatatgacctgttttggataagacgtattctagacttttatttactctgcttttaagtattatatatatttagcccttaattttttgttcctgtcaaaccttttattttccacgaagaagtattgtcaaccaaccattctgccagccccagaacttttcacatgcaactttttctccccatggttggcaagggatcactgtaattatttcaggcatgaaaataagcatttatacacttacttttcattaccttaagaaaaactgaacaagtaactggaagcattttaataagtgtggcagggcaaggtattaataatttacaggagcaatatccctgtacacaatcccttcctcgccccattggagtagtcttatcagaaaaaagaaaaaataataagagctgattattcccatggaagattgtcctgagggcatttgtaaaggtaaaactttgaagctgcagtcttggcacctgtagttgagaagatgtctcactgaagggacctgggacagacccatctctgattctctatgggctgctatgttaccagttctcaaagatgggggaagagaattgtgctcaggctgagttctgcactcaaatgaggaacggtaagatggcaaccacaatggaataagaacctgccctcccccaccctttttctctggaccttgtcagccctaggatccttgtaaagtccctcccttgaagggagtggaagtaagtatgtaccaatgactgatattgatcagctgctttcctacctaggtgagcaagggctcagattgcagagtaatttgatatagaaaactaaattgaacaattctagcaccttgtgttatgcaggaacttattcatgttatatatgatgatggatattgcctaccattttttaataaaattgatttccacaagacctgtttttttggggggttgggtaggggggcttgatttttcctacaggaagatgagtctttccctggatcaagtgtgggagaaagaggggaagaccgtggaactggttctgagcaaaagtgtaagttacactattatggaaaagatctatgcacattttgaaactcgaaggttttccagaattattgagtttatacaaattctgtttttaaggctgaattagcagctatcagaatccattacaatttttttgttttctttttctttttctttttttctataatagaataggcttgctgttgaggaaatgtgtgaaaataccagtgggggagcagatttttctaactgattaaaatatgtggagctgctgcaatgatttcctctgtgtttcctttggctacagataataccacaaagctaactcagtgacgcacatggccagctgataacagctgacacatgtgaatcgaaagccaagtgtgtattatcagaaagtgagttaaaaacccataaaactccccactgtctgacttgaaaacattcctcttgaaattttaatgacatggtaggtaatatttttaattctgcgtgctaaaacacttccagtgaaatctgagagtaaaagcatgtccctttaatcaatatgagctagatatacaacctaagtattaatatattcctgcaatagcaggattcctgagaattgcgtaaaattggtatcattcattaggatgtacaactaaatattggacgatcttgatttgccttttaaaatttaattttaatattgtaatcaaacattgacaaagttaaaaaactccaacagtaccatagctttaaaaagaaaaccagcagtcctctgctaaaacccttcccatcacagattcctgttccctggagatactttcaattattgtagtcgttatgtttattgtttactgtaatattttaaaataatcttatactattatttcttcaattttaattcataaaaattatctaatgacttcatattactgaagatatgaattttggtctcttctactgcccacttctctgttcacactttccttttcctatccttccaatgcgacttttgatgaaatcagtttggtacatttttcttggttaaattccctgcttattatgattatttaaacataattcaccactgagccatagtgaattatgatcctatttctttcttatacagcttttcatttttcatactaattgctttttgtcaagtttagtcttctatgcagccatcattaatttattcccaaacttcccacaggacttcagatcttctctcatctctcaatatgttaaaatacacctaaaagttaaataaaaaaataagctaataggtactaggcttaatacctgtgtgacaaaataatctgcacaagaaacccctatgacacaagtttagctacataacaaatctgcacatgtacccctgaacttagaataaaagttaactaaaaaaaaaaagtccaccaaatgtgggccatgaagatgcgcagcccagatctccttacagagtctgctataggacacatggggattgccttcagttgctgctcctacagctgcttagaacatgcttcccctaggttgttctcggccaatgactgaacatggctggggtattagggcctagtcctgtcctagtaccaatgaacaacttttgtgtgggactcccctctccactggcctggctacaactttctcagaactgtgctgtggtctggggcttttctacccaatcctcccttccctctcctttcaaaaggtcatatctgcaaacagttatccctgcctaatcctggtctggccccctttatccttcacagacattccccccagtaaatttcttgcacatccaatctcatcttggcacctgcttctcaaaacggggccctgagaggagtctgagaaagcaggctctaagatggacatgtggattggcttactctttgccctgatggtggtaaggaggaccccatcctgagagtaatatgaggtcaatggaacctggtacagttggaggctcaattacttaaatctcacttgtggtgatttgggaaaacagccagagggctgatgattgctaagttatattgatgtcctacaaaggataatgaaaaactgagagtgattaacaaatagtgaaaggctaaatgtaagtgccagagggactgttggtagttcacaaataggtccttatcttccacagtagaagaacatacacagctgagaagcagacatgggattttatagttaaagtcacaaagcctcagaaacatttaaatgctcagctgaggcaggttctggaaccctgacacatgcgatagagacatctaggagaatgccttgagattttttttttttgagacggagtcttgctctgtcacccaggctgtagtgcagtggtgcgatctcggctcactgcaagctcctcctcctgggttcacgccattctcctgcctcagcctccctagtagctgggactacaggcacctgtcaccatgcttggctaattttttgtatttttagtagagatggggtttcaccatgttaaccaggatggtctcgatctcttgacctcatgatccgcctgcctcggcctcccaaagtgctgggattacaggcgtgagccaccgcgcctggccaagggtcttgacactacagatcccctgaaccctcagagcttacggagacatctcctttttccatagcaagggctactgcttcctctaattggaagatgctggagaggcctcttcccaatcaggcaagcgccgcctcaggaatgcctccattcctgagggtcaaatcccagtgcagcttcatggggaatgtgctgggcctggtaagaaaggaaagaaaccatgtactaaaggaacagcaggaactagttagcatgaactagcagaagccaggggagtatattagtgattggattttgaggaggtgatatggtttggctctgcgtccccatcaaaatctcatcttgtagctcctataatttccacatgttgttggggggatccggtgggagactattgaatcatgggggtgggtctttcccatgctgttctcatgatagtgaatgggtctcacaagatctgatggtttgaaaaacaggagtttctctgcacaagctctctttgcctgccaccatccatgtaagatgtgacttgcttcttcttgccttccaccatgattgtgaggcctttccagccacatggaactgtgagttcaagtaaacctctttcttttgtaaattgcccagtctcgggcatgtctatatcagtagcatgcaaatgaactaatacaaaaggcttgatcaaggggaccgagaaatgaaattgtataagcaaaatttattgacttgggggtactttcttgggacataggatcctggcaaggaccccaagtgatggaacaaacttgttgccagcatggacctttgaaacctggaaaaagcaatggtctgaatgaagtggaaatgccagacatcagaagaattacaaaggctaagggaatcaggcaaagagtgaagactttaaatcagatgttaatgcctaccagaaagcatacaccatggaagaggcactgaacaactaaattgacaaaataacttggtcatttggcattatccagtcttcatgattggtcactctggtactaatgggaaaggaataataacatagtggtcatcatggtggcagagatgaaagatatacatgggcccaacagtgggaactttcccacttaccaaggtcaatctacctactgctgcctctgaacatccagtttgtcattaaccaagatcaacactgagccctgatatggcattattgctctaggggaccaaataaccacttggtggcaaaccaaccaaattgggtctcttatctggtggatggaccagcagttcgtccactctgggacagatacctattctgggtatgatttcctgcccactgagattcagctaacactgttttctgggggcttaaagaatacttgactcataggcatggaatcctgtacagcatagcatcagacaggggactcacttcacagtgatgtaggtgtgggagtagggctatgacatgggattcactgatcctatcacctactgcatcatttagaagcagctgctccatagagggttgggatgactttctaaaggcacagtgagagtcctagttaggaggcaatactctgtgaggatggtgtatcattattcaggatgtagcatatgcattagactggagaacttcatattgtattgtgaccccaggaggacgaatacatggatctgggtaccaaggaggtggaaccagaaatagctccatcccagtgatctgctgggggcctttgtactttccatcttgcaactttgggctctgcatgattgaaagtctgtactagtttgggttctctagagaaacagaaccaataggatacacacacacacacacacacacacacacacacacacacacacacaccccttccattcctgagggccaaatcccagtacagcttcatggggaatgtgctgggcctggtaagatgtgtgtgtgtatgtgtatttttatatataatatatgtcctatatatttagaagtacatatatacttcttatatatttatatatactatttatttacttatatatataatcttatgttctatctatttagaagtatgtatatgtcctatatatttagaagtatatatttttatatacaatatatagtcctatatatttacactttatatatacacattatattaaatatatatacattatatggtaccttcatattaaatacataaagtatatgatatacttcctaatatataggacatatattaagaatatatgtttttatatctctctatatatttatatgtatagagacatatcctatatgtatattcttagtatatatgtactatataaaggacatatacaaatatatatggtttttttaataagttttttttattttttagttgtattttaacatattgagagatgagagaagatctgaagtcctgtgggaagtttgggaataaattaatgatggctgcatagaagactaaacctgacaaacaacaattagtatgaaaaatgaaaatatacaaatgtatatgtccttaatctatataggacatatatattaagaatatatctctgtatatctcttatctttctatctatggagggattgatttattataagaaattggcttacaaaattatggaagctgagaagtcccatgacctgtagtcagtaagctgaagacccaggtgatctggtattaacggtatagtttcagtccaagtctgaaggcctgagaaccaggagagctggtggtgcaagttccagtctgaatgccagcaaatactgatgttgcagtctaaaaataggcagagggagtgaattctccctcacactgccttgtattctacttaggccaccaacagattgggtgaggcccacccacactggggagggcaatctgctttactcagtctgctggttcaaatgttaacctcatccagaaagaccctcgcagacacacccagaataatgtttaaccatatatctgggcaccctgtggaccagtcaggctgatacataaaattaaccatcacaaagtctatgtccccaaagggagtcattcttgcaaagagacacagtaaaggtctccttgaattataagctacagctactgccagaccacttttaatttcctgtgtccaaggaccagaaattggggacaggaggcaccatcttggcaggggcagttggcaagagaaggtaagactgctttcccacaatgggagcaggaaggaattcatgtggaaccaggtggtcctctgggtaccgcgctgcccagtgtaactgtgagtgggcacatgcagcaatcctaacctgaaaagtctctgattagaaagagctcaggctcctcaagagcaaagttttgggtgaaaccaccaggtcagcctgaagactttctgaggtgacagctgaagattagtggaattctgagtaaataacgatgaaaggagaggacgagtgcccatggcatccctaaaaccacctgcagtgacgcaaccatcatgcatcccaccagctttcctcttctcagattcctttcaagaagagaggcccatgacactttggaggaactgctcctcaaatgtgcctgaaatgaatctttttttttttcccttggcttcagcatcccaagtagctgggattacaggcgtccaccaccatgcctggctaatttttgtatttttagtagagacggggtttcaccatgttggctaggctggtctcgagctcctgacctcaggtgatccacccgcctcggcctcccagagtgccgggattacagacatgagccaccgagtgcagctgagaagcgaatctttcaagaagtgtggctataatgacaacaagagagaagggagaaaccatgtcaagaaacagtttatttaatatgagggagtgtattttaaagaacgcaaagtgggagcgacttattgaagatataagagagagggaagagataagtgattgacaataaattgtccctgagaagataggaagaaataggaccttggcagaggagtggtcaggagaaaagagaaagatgctctactgtgatcagagaaaagagtcaaaggagaggtatgagcctacatttatagttttggatgcagatggtgagggcattcctatgtgatgggttctttttctatttgaagtttgaggcaactttgcttagactgaatggcacttggtagcatgagagtggtgtgaaaagagaggtgaggtgattgtgggaatagtaggtgcaattgagatatttgttcaaaaacaagtggatctttaaaatcattttttgagcactaacaatgtcaggcacactactgagctcttttccgcattatttctaatatttaaacctatcatacttactctgagaattaatgaatattgcctttaatttattggaaaagaatgttttcttacttgtccaattcattcctttacttgtttaacatatatttactgagcttcaattatatggcaagcactgttctcagcatagtaagtaagtgtatcagtaatgcaaaccaagggctgcctgatttcaaaatccagtttccttatagtatgtcaataaaaatgatccaacaatacaaaatattgactctgtgagccctctaccgggttcacctattctaatgagacagggaactactactttatacaacaaagacagattgattatttatagttgtttaaattatttcaagtatattttcaatgataagtttggaagttgaattccaatataatttctttatggtaattaagaagatgaattagtatcttattaaaatgtattttccttacatattcaaaagcaacatcttgaatatttgaaaacgcttatggtaaaattatgactaattcatgatttagtgcatcgcacttcagctgaaatttacattggcatttactttgaagaaataatttgataaccaatgtaataatttgcacaacatttaaaaaaggtttgtgagtttgaggagtggttgtggttgcatttaactcatcctttaaaaccagctttttttaattggtcagcatatttctttgttagtaactccagtcatttattgaagcacactcaaatgatatttacttgcacaaacatattagggttataatataccttttctgtttttaaatttctatttgttgcaattgtagacagataaacgttattggccccctgtgcacatggggcttttgtgggaaaagtgcaatgctataatacattaaaagccataagcttttacattaaaaagcagtgatgatgggatgagggtaagtgccatcccatggtgttattgctatagcatcagctgtggcactattttcatgaacagacttagagttgagtacctctcaaagcaatttttatgtttgaacaaatacagtgatggatcagcagagtgagttactcatcaagaacttggcaagaaggatgagttacgctgagcaaaaatgctgctgagtttaatgactctttgggaacatgtaggcacttaagtctctggggtctaaatctggttaattcacaagtgtgaaattgtcagcctacttaaaagaggcagaaattatgcaatgcttttagaaagcaattttaatgtaagaggagcactggaagccagacagggcatagtagtattatattaatgacttttgttttgtcatggtagaacagttaattgattccatgaggaagatggaacaaaagagactttctagaaatttcattctccttctaggagagaagagataatcagggaaggatttctcattttaaatctctgaattagttcttattcctgattcaggaaaggttttctctaataagtatgcactcagagtttgaagaaaaatgtgatgtgactaaagagaaaaaacaataatatgaaatgtctttattaccttaaataagtaaaattagattcaacatacccatttgttagatactgggatttttgaagggatgatttaccatgtataacatgttctcatttctcaatgtatttcacttccttggccttcaaatattgcacttgttactattcttacactttaccagtgaaattaaatcaaggcaaataagagtttttttaacatgtttttaaaactttttagagataaatgtgttccttccactcctatcgaaaatggagtaacaaggactttctaccagaagcaactagaaaaccaagatatatacgtctggtttttaaaccttgagcctaagatatcataggcctgtgattgcttcaagaaaaaaaaaaaagaaagtgcgctctaaaattgcatttttttttttttgcatagcaggtagtacagggaggatgcattcagagaccagagattctgctaaattgaagaaaaagaggaactaacccacaaaggccaaatttgttagaatttgcaagcagtctaccagtggggaaggaacagcacaaagacagagctctagaaatctgcagagaggttcccacaagtctttggatgaatactgatctctataatgcatgagaagaaactatctgagattggagtgggtggaacaccacaaatagagtgaggagaacagtttcagagctcaaactggctagaaatagttcatgttttcaccattaaagtggaaataatttgtcatacaaagagtattgggtagaatgctcagaaaactgtcacctttgttgtggggataaactggctctatgctaaaggctgctctcaacacacacaaagcttaaggacaagcatcagaatgatttaactggttccaagcaacttaactgcatgccaaagcaaagtctaatgctattttaaggaatacaacaaaactcagtaaagaacaacgtaaaaatcacaatgaatggcatccaacagaaaactaccaggcatacaaaaaaaaaaaagaatatgattctagtaagataaaaaacagaaacaaaatctacaaaatagacccagaaatgaaaaaaataataaaaccagcagataaggatgttaaaatagtgattataaatatgctcgatatgtttaataaggtaggtaacaaggagataaataacctaaatggaatttctaaagctgaaaaacacagtatctgaaagggaaaatgcaattgaatggggtcaacagctgattaaacaatgtagaagaaaagatcagtgaactttaggatgtagaaactatccaaaatgaagcctaaagaaaaaaaaatggttaagacaaatggacgtaacatcagtgacctgtgggacaatatcaaacagtctaacatgttattacatctaattggagataaagaggtgggagacataaaaatattcaacaaaaaatggccaaatatgattccaatttgattataaacagaaattttgagaagaagccagagggggaaaaaatcttatcatatacggaagaacaaagaattgtcacagatttcttgtcaggaactgtgcaaactaaaagacaaatttaaagttctgaaagaaaaaaacttgaattttgtactgttgaatatatgtttcaaacaaatgcaaaaggaagactttttacacacacacacacatacacacacacacacgctctcttgagaaaatttgtcaaaagtacacctgtacaagaaatgttaaaggaagttctttagggcagaaaattcataactgtttttttttttattcattatgcctttttataaatgttgacatttttctttattgtaatgtatttttaccatgaaatttactttacctgaaatcaatattgctatttttatttattttacctgatttttgtcttaattagctactgttttttcttcatttgtaatatttataatatatttatttaacataccttttctaaggtggaatagtttgaatgctactttttgaattattctgtgtttgtctctttttgaattgaatttaagcaacttgaatttagttataacaaatatatttagtctgtctcctgtcattttgttttatattgtctaaggcttcattttctatgccaatactttcgtattctaaattttagggactattagtttatgtatgggtatgtgtgttgctgttgcttatatggagcatattttgtttgcttttataaattgcctactgcattagaaggcatctgtaaggcttaggtccaattctattagtgatcactttcacattcaaaactatgcttgaatctttttttaaatttccctatttctgaatttcaagaatgaaaaaaaattgctacctgtaatattacatgaataatttgatgtatttcaccattcttctagaaaatatactcatttttgctatttcattatgttattaactttttaggagactatcaaattgtttgcaacgtgatgatgtcatttcatagtcccaccaactatataggaaagatgtacttgctattgtagccttaaaaatttttagcctttagaagttttatagttttagtatttatattacggtctgtaatccatcattttgagttaattttttaaaaggtgcaaggtaaagattaaacttcatttttaccgtatggatatccagttggtctagatcacttgtggaaaagactatttttaaccctgttgaattatcttgacactttgattatcttgaaaatcaattgacaatatatgtgtgggtctattctgaattctcagtttggttccatggatctatgtatgtattcttatgttgataccatattctcctgattactgtatctttatagtaagtcttgagattaacaagtataaatcttccacttttccctcagctatgctgaatcttttgcatttctacataagttttagaatcagcttgaaaatttatgtcaaaaaagcctgtgagaatattgattaggattgcattgaatctacagaccaatttggatataattgaccttttgacaatttcagttttctaattcataaacatgtatgccttatctttttgtgtatatcatttaatttttctcaaggatatttgtataggtgttgcacaaaatttgttaaatttcttccctgtctcaaagtagaaaatagaaaacaatcacagagatgccattataaaatatatagatatagcaatcctctaaaattcccatttaactctgtagtttgaccggaatgaaagacggctatcttggagaatgatgttagattaatcaagtagtcactctaataatagcaactgttccaactaccatctccatattgaaatcctacaaatgtttcctctttaaaaaaaaaattcaaaacagaagaaccagcagcatgtctttcactaactgattcagttagctcctggggcagtgatcatctccctattttataggacatcatactcatccgttacattgaagataccatatagattcttggatagaataagaaagagagtgctaggtgccttagagtacatgtactgatgaaaatacaggagcctgacacttaattaaattttttggaatttaggagccttggtcaagaaagatagatatctttattagagtaactaatttttttttaaagagatgaagtctcactttatcaccaaggctgaagtgtagtgggcacaatcatagctcactgcagcctagaactcctgggctcaagtgattctgccacctcagcctcctgagtagctcggactacagacacatgccaccatgctcagctaattaaaattttttattttttgttttttatttatttttatttttatttatttttattttttatttttttttagagattggatttcaactatgttgctcaggctggtctcaaacttctggccccaatagatcctcccacttaggcctcccaaagtgttgggattacaggtgtgagctaccatgctctacagcaatgatttgctgaaccttgtccatccttcaatgtttagggtatcttttagattttgtaggcaacttatcccatgtataggtgtgtgctgcctaatttattaactgaatgacctaaaaagcttccccattaaggcccagaacaagggagggctttcctgatggcccaggctgcagtgtaaacagctaaactgtttggctcccatgttgcttaaagtgtctatggaagatacgaatgctgtggcaagtcctataagaggattgcagaagagactggtatctttgatttgagatgcagctggaatggaaatttgtctcacttcactttctgcctcatgtttcctccatcaccaaggaagctggtaataacttggttggtctgaacccatgcacagctcagaagtgtgagtgagttaatacccccaaggaaaacttttgactaattgggggaagaaagcagatagataaatgcttctcctgtttccctccttctgatagaaaattcagggaggtatctggaaacttctcaggagccctcaacagaacagtgcattaatatactacagccaaataccactaagaacacatctgtggcagaacaagttcggctcaaggttcattgcaacaagggagaactcccctcatagggatctttgggacatttctgtaagatggtgttaaaaggacgtataggatttttagctatgccaggtattttgaggagagttcaagaatgcagggctttgttatggattagatgctgtcaggaagtgaggataattctgactgggtgtcttaaatctttacaaggtgagaagactaaagtgagggtaaatctaattgataaagaatcatattagcaaggttagggagacgcttggtcatttgtatggtttggataatgttgtttttaatctgtgttcagatgtgattacgaagtggtatttttgctctaattcattacagttgtggtgtggccttgttgatgttgatgttctaggaaaattgttcacatccaacaggagaatgttgagacctagctgtgaatgccaggccagctcttagcaaaaccaaagtctagctggtagttccaggctattcttatcagttaagagctatttttctctctctcaagaaccactggttttctggaaggaatagcttcaagaataccctcttataatggcttttcatccttcctgttgcattctttctggcctctcactctgtctcagtctataccttcagccttctgtaggcatggtaactcaagttgagatactctttcaggaacacaaacaatattctaaatagtattccccttttgaaaaacagctgcccatcatgaactgtgctatatgatccatctggccataaggtcgggacgtgctaactatgctccatcattaagtggacgtagatattctcaacagggctcaattgttcctgaaggcaaaagtacctttcctgaataggacattcacatgtccagtgtgccttcactttattacccttcagtttgctcctgtggcctgtggacattcccaatgactagttggctgaggaggtatggctgtgagtctgctttacagatggctctgcatcatatggcatcatctgctataactggccaaaataattatgaaaaagttcagctccattcaggattggtttagaaaggacattcctgaggaggcagaatttgaaacagaaaaactcattttcccaattgtatcttgagctaaggatataaggatgggacaaggatggggaaaagttcagagctacttccttggcagcagttttctgtggcagccatgtcagaggacagtatcatgttgacatcagcagtggcatcaatcagtctcatcctgggttatggtgatggaggaccaggtacctacatgctccacatctttcccgatgccttggacttacctaaacctctgagatgaagctaaaatcctggaaaaaaaggaagtatgtaggaaaaccttgatttcactgaggaaaaaattagaataaaccacattcaccatatattgactaatattatgtttttaccaccagagaggcttgagacaaaaaataagttcagtgatcaagaaaacaaagaaaatatccactctcaaatttgtagcctgataattcagacctgtagttagaagtattgacagtggctttctagatagagacactaagagagagactaggaaacttaggttacttaagttttcttatttgtactatttttcatacatgtaacaaaattttttacaacaaatatgtattacctctataatcagaaaactataagcattgctttagaggaatatcatcaaggcaaaaacactactgaaagtcaatgatgagtatctgtgactagtattactatggttattattattacatttaacctaatagaaatggtactatacatttactattataaaccttatcctaataggagttatagttgattaaaacacttaaatttatcttgttgatattttcttagctaataatattatactataaaattaatacttctcggtcttttttgcaaactcttaaaatatgaaagacaaaattcttacctcttggtcatgtgagtcatcaatgactgtggaagctactcatgagctcatgcttatttataatcttgaatatgtgctcacacagattatataacattaagcaagaagcaattcactggcaatgcctaatattggggcagatagacacttatatgagttacacagaaaatattattactcacttttgtggacagtgggggcagagaggatttgttttcagctctaacttcagtcaggaaatgtctctactgttaacaagaaaagctctagacttactaaagttaacagcatttatttgagcaaagattgattcatgtattggtcagcactcagaaccagaagacgttcagagagctctgctctacaatgtgggcagtgagtattcatagacagaagaccatggaagcacagaaataccttaattggttacagctaggcttttgccttgtttggacatggtatgaataactggctgcttgtcatttgctgaagctctgctgcttgtgattggttgagatccggctattttaactcctaaattagattgccctacaggttgcagttctttaggtaggaacttcaagtatacagacagcctcaggctaatggccttctgcttatttaatgtagcagtaccaaaagaagtttcattctaccatatcccctttccattactgcagtgtatggaaagccacatttatcccacagagagaatagggctggaacagagggatctgaccacagtgagagggcagatcgcagagactgaataggagtacggtgctgagtgtgtagacaggattcagaaccttccacagcaatcagctgatacagactcaccgcctaatgattcagaaaatgagggatcaaagactagaatggagagagaaaaaatgaagtgtggcaagagcaacaaggggtagtgggatgcacagaaaggatccaaaggacatcagcactaatccctcagttgacaataatggctatctggaagccacctacccctgagaaattgtgaagtacatgtgtagatctcatgacacaaaagaatacttttagtatattgctgctataatcaatatgattaaaaggttaactacaaatttggagcatattggtcacaaaacagctgacatttctttctggatatgtaccaggtaatgctgagcagtttatatgccttgggtacatttaatttttccaacaacactatgaggtaggtactgttttcctcattgagaaaagtgcagaatgaccaagtggcttgcttaaggtccacagcaaatggttggcagggccagattcaggctgagatatctgacttcagagtctgagatgttaattactgcatagacttcttttccaaactgacggatctctgtgaggagcatcatcacatctctgttaggagcaactgttaatttattaaaacctactgtaggctgggtgcagtggctcacacctgtaatcccaacactttgggaggtcaagttgggtggatgatgaggtcaggagtttgagaccagcctggccaacatggcgaaaccccatctctactaaaaatacaaaaaattagctgggcgtggtggtgtgcacctgtaatcccagctacttgggaggctgaggcaggagaatagtttgaacctagggggtggaggttgcagtgagccgagtttgcaccactgcactccagcctgggtgacagagcgtgacactgtctcaaaaaaaaaaaaaaaaaaaacaccaaaaaaaccaccactgtatattccttagagtttagatagtatgactgagtggagaaaattttaagagtgtggattcagcatcttcaacagaatttttggttctgttttcttaatttatcctatagagtagtttcaggtactgatatttgtggatacttggaccaaatggaccatatcaaatattatgccagagattctgatccctaaactaagtagaataggcacttgatttataattgtgtcttaacaacatcgtttctctcttatcttgtgttactctttgtcatttattcctcacaggaagaaagaagtacctaaggccccaccattagaacctgactctgtgtttctaatgcttcaggccaaggaggaaaacactgtatttaatgcgcttgcagtatttctattcttgcaaaatacttactgttccaagcaagtgagttttcaaataaaataagaaaagcattttcctatttttgctgcttaccttattgctctataaccctctacaagtgtatctatttccaaatcgttttctctggggaggctacatttcacacttctacaacataaaatactaccacagagattcttaacagttgacatttgtagacctccttgattgaaaggttgtgcagtgaatacatttgttttggaatcaaataaatattatttaaatttggaaatagatacacttgtagagggttatagagcaataaggtaagcaccaaaaatacgagaatgcttttcttattctatctgaaaacccacttgcttggaacagtaagtattttgcaagaaaaaaattacctcaagcattttaagtacagtgttttcctccttggcctgaagcatcagaaccatagagtcagattctaatggtggggccttaggtacttctttctcaccgtgaggaataaatgacaaggagcaacacaagataaataaacctgttctaatctagagctaatatgatataatttacaaatgttctggttttaattttaaacaaattattctgcctgaccccatgtttttcattgcacactaatattgatatttgacacatcagattattagatattcataacatttgattcctttggctatcatggatcattcttttattcagtaaatatttatcgaaagccttaaatgagccaaactctattctgattctgggaatatagttggtaacaagacaaaaaagatcactgttcttgtggagtgaatattctcatgaggaaagagagacagtattcaaaatgtaagaggaatatgttagatagtgatgagtgctctgatgacaataaggcagagtctgatgatagggagggacttgggggctcctttggagtgagtaatccaagaagactggaatggcaagcagggaccactgctgtaaaatcagtgaaagagcatcccagatacagggaactgacagagctgcagtcaacaacctagaaccaggctgttcaaggcagagaatgcacgaatcacagattgctttatctagacaaaataatcaaaagatatcctggcattcccccttctgttggtgaggctccaagaccaacctcacaagacaaatggtaagactggtttgtttggtaagactggttttattaactactcataaagatggcagaagcaacagaattgactttcttgcatagtaaacaggagactagtctgtgagtgacctggagaagcttagtacggctgtggccagtttgatagttaataggttaattctgataattatcagctgagttgatagttaatcctatattgaaatcctggaggagaaagaatacaaaagagatgacatggaaaccagcttcttgttcgcacttgttactgagaaaacacactgcataacacacaggttaaacgctgtttgctgttcatggggctttaattggagggtcactcttctggatgtttgtatcacaagtgcattccagtggcactggcccaagctgttatttccaccttgtagctcatgtggttttgctatggtgctgatgtgcgtaaatgtggttgtttctgtggttttcttacaggtcctggagaattacatatcatgcaaaaggttataggtcagcttatctttgcagatatagaactaggtaaaactcccctaaaataccggtgcttagcaaagtaaccttgcaagtttactttgcccttcaatgatcaacaacaaaaaccaaccaactaaacaaacaaaaattagaactcattagcttaacgatccatcattcattaatactcttgagcttatggagaaaacaaccaatatataaaatattcttcaattgtacctgctgcttttatttcttttagaagtatttttttaagctgtacttttcctaaagcctgagaatattttgtgttatttttgatgccagaaaggataatataatacactgtatgtctttaattcgttgtaactggtggaaaaagagaaagataattgaaaccttaaaacagcagagataagtgatctaagttgtaaatctgttagtaattcaagaacatttagaaatatctcctgataaggttaattgaaggaatattctaatgaatgtagtaaattagttgttcccaatctcaaaatcttttaatattctgaaagaaattaagattttagtgagagatattccactttatggaactacttctttctccctttatctctttatggaaaattctatcttaaggagcaaggtgaatctttcttgttctcttttactgcaaaatatttgtttttaatatgtaactaacctgcacattgtgcacatgtaccctaaagcttaaagtataataatagtaaaataaaaaaaaattgtttttaaagcaaaacaaacttacatagaatcaataatttctgttattaaattatagaatgggaagatgtattgcttattgtgatgaccctcaaccctggctgcacattagaatctcctggaatggggcttccaaaccttagtgtgcttgtgaatcatctagggagtttgttaaaatgcagattttgatttaggacttctggggtaggacctgagagtctgcgtttataacaaactcacaagtgatgttgatgcttgattagcctgttctttcattgctataaagaaatacctgagactgggtaatttatgaagaaaagaggtttaattggctcccagttatgcgggctttgcaggaagaatgatgctggcatttgctcagcttctagggaggcctcaggaagcttccaatcatggcagaaggtgaagggggagcaggcacatcacatggcaaaagcaggagcaagtgagagagagtgggccaggggaggtgccacacactctaaaataaccagattccatgataactcactattacaaagacagcaccgaaccatgagggatctgcccccatgatcgaaacaccttctaccacgccccacctccagcactggggattacaatttaacatgagatttggttgggcacaaatatctgaactatatcctgccctgcacctcccaaatctcatgtgattcttacattgcaaaatacaatcatgccttcccaacagtcccttaaagtcttaactcattccaacattaactcattccaagtccttaactcattccaacattaactcaaagtccaaagtcttgccttgagacaaggcaaatcccttccacctatgagcttgtaaaataaaaaaaaagttagttacttccaagatacaatgggagtataggcattgggcaagtattcccattccaaaagggagaaatcggccaaaagaaaggggctacaggtcccatgaaagtttgaaacccagcagggcagttgttaaatcttaaagctctaaaataatctcctttgacttcattttccacatccagggcacactggtgcaagtggagggctcccaaggccttgggccgctccacccctgtggctttgcaggtttcagctcccagggttgttctcacaggttgttaaatacttgcagcttttctagacagagggtgcaagctgctagtagagctaccattcttgggtctggagggtggtggcctacttctcacagatccactaggcagtgccctagtggggactttgtttgaaggctccagcccacatttcccctttggcactgccccagtagaggtttactctgagtgttttgcccctggagcaagcttctgcctggaagctttctcaggcatcccctgaaatctagacagaggcccccaagcgttcatcacactctcacattctgtacatctacaggcttaacaccacatgggagccaccccaaggcttatatactccaaagtggcagctggagctatacctgggcctctttgagccacagctggagctgagctggagcagccaggatataaggagcagagtccctgggcctggcccacataaccgttcttcccttctaggtctctgggcctgtgatgagaggggttgctgtgaaggtctctgaaatgcctttgaggcttttttcttgttgtatttgttatcagcacctggctcccttttaattatgcaaatttttaattttgcatcaaattaaaccagcaagtggttgctccatagcctgcttgaattctccctaaaaagctttttctttctctgccacatggccaggctgtaaatttttcaaactttcatgctctgatttccttttaaatattaggttgatgccaaacaatcacagtttgcaaaaacaattacttttaattgcaaaaactgcaattgcttttgcaccaacctaatataaattccaactttaggtcatttttttgcacccacatcagagtgtaggctgttagaagccaccaggccacatcttgaacactttgctgcttagaaattttctcttccagataccttaaaccatcactttttagttcaaacttccacagatccctagagtataaacagaatgcagcgaagctctttgctagggcataacatacatgagctttgctacagttcccaattaagttcctcttttccatctgagaccttgacagcctggccttcactgtccatatctctgtaagcattttggtcacaaccatttaaccaatctctcagaaattccaaactttcccttatctacctgtcttcttctgagccctgcaaacacttccaacctctgcctgttactcagttccaaagttgcttccacattttcaggtatctttatagtaatactccactcctggtaacaattttccttattaggccattcttgccctgctataaagaaatacctgagactgggtaattaatttatttatttattttaaaaagaggtttaattagctcatagttctgcaggctttagaagaaacatggcactggcatctgcttagcttctagggaggcctcaggaagctcacagtcatggtggaagacgaaaggggagcagccaggtcacatggtgaaagcaggggcaagtgacagagagaataggtaggaaggtgccacacactttgaaatgagcagatctcagaagaacttacactgactatcatgaagagatcaccaagccataaaggatccactcccatgattcaaacatctcccaccagtttccatctccagcactgtagattataattcaacatgagatttgggcagggacaaatattcaaactatatcatgtaggctttacaggaagcatgatgctggcatctgctttctaaggaggccttgggaagttttcagtcatggcagaaggtgaaagagggagcagatgcatcacatggcaaaatctggagcaagcaatagagaatggtgggggagggggacgacacacacttttaaatgaccagatcttgtgagaaagcactatcataaagacagcaccaagcaatgagggatcttcccgcatgatccaaacacctcccgccagactctacctccaacatagaggattacaatttaacatgagatttgagcagggacaaatatccagactatatcaatgctgttggtctgtggaccataatttgaatagcaaggagagagagcttttagaaattaccaatacaaaggccaagacacccatatatttggattcatggtatctaacacggggtccagaaatctgcatgttaacagaaacaacatgtgattgtaatgcatataatccacagatgggagtttggtctggctagaaggcagtactagccctgattgtgtacaggattagaatcccatgcaaatcattaaggctgtaattcctgtgcctctgtagtcttaatatttttatagcagatgctgatgtaaaaaaccactattctgggcattcaggaaagaacactatcattgtatgaacttagtgaaatgatgtgggaattttgagtgtatgcacaatcataaggttgtggttcatagctattaattgaatctttcttaaaatgtttttttgtataaatatatgggatacaagtgtaattttgttacatggatagattgtataccggcttgtatactggtgatgtcagggcttttaggatatccatcacctgaataatgtacattgcatccactaagtaatttcccatcatccacccaccctcccatctccccacccttcatgtctccattgtctatcattccacactctatgtccatgtgtacacattgtttagctcctacttataagtgagaacatgctctcttgctaccaattaattttttctttaagaattttcagattttactttagatatatgtgcaggtttattatacaggaatatagcatgaggctaaggtttggagtatggatcctgtggctcagatagtgagcattttacccaatgggtagcttttcaacccccattcctcttcctcccttcccacctctagtagtctacactttcgattgtttccaaatttatgtccatgtgtgctcaatgtttagctcccacttataagcgagaatacatggtatttggttttctgtgtctgtatttgtttgcttaggattatgacctgcagctgcattcatgttgccgcaaaggacatgatttcatcctttttatggctgtgtagtattacatcttgtatatgtaccacattttctttatccaatctaccactgatgggcacctgagttgattccatgtctttgctattgtgaatagcacagcaattaacacatgactgcatgtgtctttttggtagaatgatatatttttccttgggtatatacctaataattggattgctggattgaatggtagctctgttttaagttctttgagaaatctccagactactttcctcagtgactggactaatttgcattcctaccaagagcatatgagcgttcccttttctctgcagcctcaccagcatatgttgttttttgactttttaataagagccattctaactgggtgagatggtatcttattgtggttttgatttgcatttctctgatgatttgtagtgctgagcatttttccatgtatttgttggctacttgaatgtcttcctttaagaagtgtttgttcatatcctttgccattttttaatggggtttttttttgcttgttgatttaagttccctatagattctgttaataggcctttgtcagatgcatagtttgtgaatattttctcccattctgtaagttgtatgtttactctgttaatagtttcttttgctttgcagaagctctttagaaataagaaatgttgccaattaaataatgagatactaattatgagaagacttaatctaattttaaagatgttaaaaattttttaaatatgccctggagtcaatgaagtatattattcaattatggaaattctctgtacatagaacagttcaggaacacaaagttatctaaagagagtttggatttttacatagctcacctattttttattataatgtttctcatatggacaatgtatagtcaaggtgaaaacacagttctaattctgttcagggaaaaaaatagtagaaattagtttcctccattctgttctatattactatttaaatttagtttgttaaaggcttaaagtttaacttcacaaacatacaaaatcatagttttttgttaaataacaacatttgaattgtataaatatattattgtatttcttaatttataaactatattagcaactagaaagaaaaaaaaatgacttagaagatattttacacatttacttacattctttatgcaacctgaaccctcatctctttttaacattagggatgacagtgggtggacagtgggtggatctgaatttttaaagttattctctagcaactagaggaaaaatcttaccagattatataggctagaactcttgattgagaagacagagtattattaaggttctgaaagaagagcttttcattattcaccagcaggttttactatctaaaatagaattacatgaatttgtaaaatttgtcaccaaaagcttcatctacttgtaaataaaaaaatcctctcaatttttggccaggtgcagtggcttacacctgtaatcccagcactttgggaagctgaggtagatggagctcttgagcccaggagttctaaaccagcttgggcaacatggcaaaatcccgtctctacaataactgcacccttaaaaaaatagctggtggtgtatgcctatagtcccagctacttgggagactgaggtgggaagatcacttgggctctggagttcaaggcgatactgagctgtgattatgccactgcactccagcctgggcaacagagcaagacctgtctcaaaaaataaataaataaatatataaatatataaaataaaaaaataaaacttctgtcaattttggataggtataaacatcatgaaaaatagtttgaaaatttataactgagaagttgctgaaaatccttgatcggatctctgcttgcaatttctgcataaaagattttgagaatatatgcaatgcaaaataaagcattccatattttaaaagaaaaatattttcttgtcttaactatgtatactttttttatttgagagaagttgctcaaatataatatagttgttgactcaagagaatcaataaaaaaaatctactgaataaataacacagtttataaaatggttagttatgacatcattgccttcctcatacaaagaatgacctgttagaaattctaataaaaaagaatcctcttgtagtagcaacaaaaattataaaatgcctaagaacaaattttaatagagatatagaggccctatacagttaaaaattccaaaatgttaataatgagattataatacttgaataattttttaaaatacgtttaatttttccataggttattggggtacaggtggtatttagttacatgagtaagttcttcagtggtgatttgtgagattttggtccacccatcactcgagcagtatacactgcaccctattgatagtcttttatcccttctcccctcctacctttcccctcaagtccccaaagtccattgtatcattcttatgcctttgcgtcctcatagcttagctcctatatagcagtgagaacatacgatgtttggttttttattcctgagttacttcactaaaataatagtcgtcaatctcatccaggttgctgcaaatgccgttaattcattccttttgatggatgagtagtattccatcgtataaatatatataccacagtttctttatccactcgttgattgatgggaatttaggttggttccatgattttgcaattgcgaattgtgctgctataaacatgtgtgtgcaagtatctttttcatataatgacttcttttcctctgggtagatacccagtagaggaactgctggatcaaatggtagttctacttttagctctttaaggaatctccacactgttttctatagcagttgtactggtttacattcccaccagcagtgtagaagtgttccttgatcaccacatccatgccaacatctattgttttttgattttttgattatggccattcttgccggagtaaggtggtatcacattgtagttttgatttgcatttccctgatcattagtgatgttgggcattttgtcatatgtttgttgtccatttgcatatcttcttttgagaattgtctattcattccttagcccactttttgatgggattgtttgtttctttttttgctgatttgtttgaattcattgtgattctggatattagtcctttgtcaaatgtataggttgtgaagattttttcctactctgtgggttgtctgtttactctgctgactgttccttttgctgtgcaaaagctctttagtttaattaagtcccagatgtttatctttgtttttatcgtatttgcttttgggttcttgatcatgaaatctttgcctaagccaatgtctagaagggtttttctgatgttatattctagaatttttatagtttatagttttatagttatacttaagtccttaattcatcctgtgttgatttttgtataaggtgaaagacgaggatccaatttcattctcctacatgtagctagccaattatcccagcaccatttgttgaaaagggtgtcctttccccactttatgtttttatttgccttgttgaaggtcagttggctgtaagtatttgggtttatttctgggttctctattctattccactggtctatgtgcctatttttataccagtgccatgctactttggtgactatggtcatatagtatagtttgaaatcgggtagtgtgatgcttctagatttgttctttttgcttagtcttgttttggctatgtgggctctttttttgttccatgtgaattttagaatagtttttttctggccaggtgcagtggcccacacctgcaatcccagcactttgggaggctgaggcagagggatcacctgaggtcaggagtttgagaccagcctggccaacatggcaaaactctgtctctactaaaattacaaaaattagccaggtgtggtggtgggcacctgtaattccagctactggggaggctgaggcaggagaatagcttgagcccaggcgccagaggttgcagtgagctgagattacaccattgcactccagcctggtgacaaccatgagactctgtctcaaaaaaacaaaacaaaacaaaacaaaaaaccaaaaagaatagtttttctaattctgtaaagaatgatggtggtattttgataggggttgcgttaaatttgtcgattgcttttggcagtgtggtcattttcacaatattgattctacctatccatgagcatgtgatatgtttccatttgtttgtgtcatctatgaattttttcagcagcgttttatagttttccttgtagaggtctttcaccacttggttagtatatttctaagtttttttttttgcagctgttgtaaaaggggttgagttcttgatttgattctctgcttggttgctgttggtgtacaggagaccttctgatttgtgtatgttaatcttgtatccagaaactttgctgaattctttgatcagttctaggacctttctggaggagtctttagggttttcaaggtaaaggatcatatcatcagcaaacagtgacagtttgacttcccgtttaccaatttggatgtcctttatttctttctcttgtctgattgctctggctaggacttccagtagtgtgttgaagagtagtggtgggagtgggcatccttgccttgttccaattatgagaggaaatgctttcaacttttccccattcagtattatgttggctctgggtttgtcatagatagttttattacattgaggtatgtcccttatatgccgattttgctgagagttttaagaattttaatcataaagggatgctggattttgtcaaatgctttttctgcatttattgagatgatcatgtgatttttgtttttaattctgtttatgtggtgtatcacatttattgacttgcatgtgttaaactatccctgcgttcctggtataaaacccacttaatcatggtggattatctttttgatatgttgttggatttggttagctactatttcgttaaggattttagcatctgtgttcttcagggatatcttcagggtctgtagtttttttttttttctttctttttttggttatgtccctccctggttttggtattagggtgatgctggcttcatagaatgaattagaaagggttccctctttctctatcttgtgaaatagcatcaataggattggtaccaattcttctttgaatgtctggtagaattctgctgtgaatccatctggccctggactttattttgttggtaatttttaaattaccatttcaatcttgctgcttgttattggcctgtttagggtatctatttcttcctgatttaaccttggaggtttgtatttttctaggaatttattcatctcttctaggttttcaaatttatgtgcataaaggtatctcatagtagccttgaatgatcttttgtatttctgtggtgtcagttgtaatatctcccgttttgtttcttattgaggttatttggattttctctcttcttttcttggttgatcttgctaatgatatatcaattttatttatcttttcaaagtaccagctgtttgtgtttcatttatctattgtatttttcttgtttcaatttcatttagttctgctctgatcttggttattttctttcttctactgagttttggtttggtttgttcttgtttctctagttccttgaggtgtgaccttaaatgtcagtttgtgctctttgagtctttttgatgtaggcatttagggctatgaactttcctcttagcactgcctttgctgtatctcagaggttttgatagattgtgtcactattgtcattcagttcaaagaatttttaaatttccatcgtgattttatttttgacccaatgatcattcgggaccaggttatttaatttccatgtatttacatggttttgaaggttccttttggagttgatttccagttttattccgctgtagtctgagagagtgcttgatataatttcaattttcttaaatttattgaggctcattttgtggcctattgaataggccacatgtgctgttgaatagaatgtgtattctgcagttgttgaatgaaatgttctgtatatatctgttaagtccattcattccaagatatggtttaaatccattgtttctttgttgacttcctgtcttgatgacctatctagtgctgtcagtggagtattaaagtcccccactattattgtgttgctgtctatctcatttcttaggtctattagtaattgctttataaatttgggagctccagtgttaggtgcatatatgtttaggattgtgatattttcctgttggacaaggccttttaccattatataatgtccctctttgcctattttttcactgctgttgctttaaagttggttttgtctgatataagaatagctacctctgctcgcttttggtgtccatttgcatgaaacgacttgttccacccctttactttaagtttatgtgagtccttatgtattaggtgagtctcttgaaggcagcagatagttggttggtgaattcttatccattctacagttctgtatcttttaagtggagcatttaggccatttacattcaatgttaatattgagatgtgagttaccattccattcatcgtgctatttgttgcctgtataccttggttttttgtttttgtttttgctttttaaattgtatttttattgtataggtcctgtgagatttatgctttaaagaggttctgttttgatgtgtttccaggatttgtttcaaaatttagagatccttttagcagttcttatagtgccagcttggtagtggcaaattctcttagcatttgtttgtctgaaaaagactgtatcttttcttcatatatgatgcttaatttcactagacacaaaattctgggctgatacttgttttgtttgaggaggctgaagacagggccccaatcccttctaacttgtagggtttctgctgagaaatctgctgttaatctgataggttttcctttattggttacatggtgcttttacctcacagctcttaagagtctttcctttgccttaactttagataacctgatgacaatgtgtctaggcgatgattttttttttgcaataaatttcccgggtgcttttcgtggcttcttttatttggatgtctgggtctgtagcaaggctgggccgttttcctctgttattcccctaaatatattttccaaattttttatttctcttcttttgcaggaacagtgattattcttaggtttggttgtttagcataatcccagatttcttggaataagaatattttcttattcttttttctttgtctttattggattgggttaattcaaagacttttgagctctgaatttctttttttctacttgttcaattctgttgctgagactttccagagcattttgcatttctatatgtgtatccaatgtttccttaagtttttattgttttttctttatgctatagatttccttgaatatttctcccttcacttcttttattgttttttggatttccttgcattgggctttgcctttctctggtgcctccctgattagcttaataactaacctcctgaattctttttcaggtaaatcagagatttattcttagtttggatccattgctggtgagctagtgtgattttgggggatgttaaagagccttgttttgtcacattaccagagttgtttttctgtttctttctcatttgggtagcctctgtcagagggaaggtctagggctgaaggctgttttcagattcttttgtcctacgaggtgttccctggatgtagtactctccccgtttacctatgggtgtggcttcctgagcagagctgtagagattattatttctcttctgggtctggccaccaatatgtcttccaggctctgggctggtactgggggttgtctgcacagagccctgtgatgtgaactgtctatggatctcacagccgtggataccagcacctgttctggtggaggtggcaggggggtgaaacagactctgtgagggctcttagctttgatggtttaatgctctgtttttgtgctggttggcctccgaggccaggaggtggtgctttccagagagcatcagctgtagtagtatggagaggaactggcagtgggccaggcccttgagctcccaagagtatataccctttgtcttcagctaccagggtgggtagtgaaggaccatctgatgggggcagggtaggcatgtctgagctcagactctccttgggcgggtcttgctgtggctgctgtgggggatgcggatgagatttccaggtcaatgaaattgtgtacctaggagaattatggctgcctctgctgagtcatgcaagttgtcagggaagtggaggaaagccggcagtcataggcttcacccagctcccatgcaatctgaagggccagtctcactcccattttgcccctgatagagcactgggtctgtttccagatagtggggaagcagagctgagagcttgtcccagactacctgcctccaagctgcagaagaaaaggaggcttctcaactggttcaaattgttacgaagttcagctggagacttccttctccctgtggcatttatcccgtgccactggaccccctcccaaagtatccctgtgacactcccatggtctttcctgctgcttcctctacccctgtatttcactgggctctctaaattgattcagctccagttaaggttggaatcttctcccacagactagacttttagtttccccagtgtgggtgtgagtttaggggtggaggatctccctttcccacttccgcagtttgggcactcacagtatgtggggtgacttctgggtcctgcaggagcagtccgtttccttcagaaggtctgtgggtcctcttgggattcctgatttattcctgcagtcattctggagctaaaactcatgatgcaagcctccacatgctgctgtatccatgcgagtccaagctgcaatctagtcctgcctcccatctgccatgacgatcctaggtatagtcatatctaatacctgaatcatttagaatatatgtcatatctctagataagaagactaaatatcataaaatatctattttctctaaatcagatccaaatgaatttttttcaaaactcaaatgcttttaaaattaatttgcaagaataaatttctaaaatgtcatacacaatttttgaattaaaacaaataatcagtgtagacttcctcactaaaatttaaaatttcataaagtttatctgataaaaaataactcacaggagcacttgcatagaaaaagactaataactcagtgacacacaatatataggaacaaatgcaagcattttgggagaatttagtacatgatgcacatattatttaaaattggtggaattaagatgaattattcagcaaatgtattggaataactggctattaaaaataacattcaattttatacttcatatttttactccaaaatatattccagatataataaatatttaagtgtaaacccagaaacaatgtaagtactaaaaggaaatataggtgaatatttttaaaatcttgggatgggaggaaggtctttcaacgtaggtgatcaaggacaaagttaataagaatattgatagatttaactgaatgattttataatctttgcactaaaatcagcatataaggataaaatacaaataatatgctaagaaaatatttcagggtatataacagatgagatgcatcattaataggagttattacaaattaataataaagtttacaattctaacaaaaatgatcagtggcatgagcagggaagccataaaagaaatgtaaaggcacaaaaaacatgaaaagtaaccaaatacactgaaattaatggagatcttgtatcagttagctatttttgtgtaacaaacattcccaaaactcaatggttacaacagcaattatctgttgtaataatttacatttctttttgttgtctgagggtttgttggctgctttaggatgagcttaactgagcttgctcttgtttctgtatgcaggctgggggcctgtctctaagttgggctttcctgggacaatttagctggggcattcctgctccatttgtctttcatactctgcaagggctccatgtatttctcatcctttttctgggaccaatgagccagcccaagcatgtccttcttgtggaaatggcagaagtacaagagtgcaagcctagctggacaagtgtttcttaagctgctgcttgtgtcacatatgctaacatcccattggctaaatggcaattacatgaccaaactcagaatcaaggggaaaggaaatatatcttgtcttttaataggacaaactaaaaagtcatatgataaaggacatggatacaagcaagtgcaaagatttggggccattaatacaatataccagatgccgtcttttgcacgttggttagtagaagtgttttgtttttgttttttttttttttaaccttgcttgtaatagtcagtgtcgtcaagagtgttaggaaatgagtactcccacacactgctgaaggtgggagtctaaatggctaattggagtgacaatttgagtgtgtgtttcaaaattttattaaaggtgtgtgttttgggctcaatacttccatttttaagaatttactacaggaaaataattaggcaaatgtgcaaaggttgtataagtataaacctggttaatatagagccagttgtcatggcagcaggaggccatgtggagcagcggctgccatcaatcctggctgcagcagagaggtgtggctttggctgtatgcttcatggaactggtgggaactgggaacaagtgggagccctgccccttctgagttggggcaggagctccctgggtgccactgaagatgcccaagccacagcagtagacctgggcattcctgtgctctttgggcccaggagcaggcgggaggctcaccctcctgggcatagctgcagccactcaaactgtggctgcaggcccatgcctcctgctccatggagcaggcaggagccccatcccccagagtgtggctgcagctacccaaaccgtggctgtagacccaggcatctgtgcactcttaggcggtcttgagaaggcccccactgatcttacgggctcagaagtacctgttcccactgcctggtttctctctgctgttagcacctgcttctttcttggagcaaagatagggccaagcccaggcactgtcacagcccagctgggtgtgtgcacacttggggcagtgctgacatgccagcccctggtcaccttagccccctccagactttgggcactgatgagcataggaggaaagctgaggcaggctgagtgcagctcagtgctggcctgcaggtaccccttggcttctacagcctgggtgccctgaatgacagattgaggtagacaggttactggatggaagggggcaggtcacaggtgaggtcccagccttcaaagagagcctgaaggctggggactaggctgccagtaccgccggactggagtggaaacttgtggtgcattttccgggcctgcccatggccacccatggacaaattggtgtacacttcctcccctctgaggcccataaaaacccctggcttagccaaagcttagcagatattgaggtgaccagctgcatagaggagcaacacactctagggcctcctctctgctgagagctatagagacaatgagatgacctgcctgcagagaggagctacccactttagggcctcctctctgctgagagccacagagatgaaggagagatgacagggagatgatgggactacctgcctgcagagaggagcaccccattctagggcctcttctctgctgagagctgcacagacaatgggacgaccagctgcagagaggagctaccttctctgctgatacctgaatacttgtcaggatgacttgccttgaatacttgtcaggatgacttgcctagcagaaaggagcaaccctctctgctagaagctgaacacactttggggaaaccctggctgtggaaaggagctgccctctgagggtttcctctgagccattttattgctcagtaaacctcctcttcaccttgctcaccctacactttgctgcatacctcattcttcttaggtgtaggacaagaactcgggacccactgaatgaggctaaaagagctgtaacacaaatgaggctgagatatgccccattgctcaccacattgcaaacaaagagaaggaaagaagagctgcagcctttcagagagcccagacctgtgagctccccaagccagggctgtgactccctctttgggttcccggcatttccaagctactgggcatcaccatgttccctggtgccagctgcggaagctgctttcggtgcacctggtccagccgcagccttgtggaaagccgactctcatgctggcacctggagcttcctgccttgctgcagcagctggcatgtctgactgcacagtggctggaccccatgctcactcacatatcccttgtgctccacacagtctcccttggcagatgtgggatccaggctggtagtgtgagctgagcgcatcctgccaggccaagtgggcggaatgagcccagcgggcctgagtgaaactcaaggcaaaggcatcactggccacagaggtttctggccagaaaagtgacaccccaaagatcctgtaacagttgcacatgtaaggctatactttttaaaaaagttgacatcaattttgattgattgattgatatttcagcctgttatatattttaaatatcacctctgagttcaatgatattaatcactagattgtttataatagtaaacatttggaaaatttctaagttccattaatataaaattgataaaaataaatgttggtacatccacacaatgggttgctatacaactgttaagataatgatgcttgtatttattgtcatgaaagaaatccatgccataatgattaaatgtaaggtaggggcttgtttcaataatatatatggttgtatgttcattaaatatatgaaaaagtatttatcagggtatttctatgtggaaaattatgggtgcttttattttcttattgtgctttttaatgttttatttgtagtgtcatgcattaacaggcactttttatgaccattaaaagacagaaagtctacttctatttttgaaaagtgatattgagaatttaattgtaattagtttcaaggaaagcgtatgagtaacaatactctgttacaaagtcaaaacattccgtagaaaatagctatgagtcttaaaggaaagacttctctagtcatatcataaatgatgtctgtttcccttttgagcaaagagacacaacttaataaaattaataggggaaactcaaatgtatagaaaatagaatatgagtaagaaaggcatggatacttttatgctgtttatatacacatgtacacccagccatgctttctgtaaaaatagtgcttgcttggttctgtaaaaggaggaaatatttcagagtttatggcaaaatcattttggaagtacagaaggttggtttggaaaggattacacatttgtcatactttctttcatgcttaataaaaaaagtgattctgatctgatgaatggaacattgttagaagtcagaaaatattactgtttctcattatacttttcatttgtcacatgactttaatgaaggaccctcctgttagcatgagagtcattatcaaccaaaggtatatagaacgtttcctctttaatgcagacatttaacaaactaatgaatactaaaaataaaactctctaaaaataatgttgcttatatactgtgaggatctgctaaatcttttctgcttttgaatacacagtaagaaaattaatttagagcttaatcagccatcataagcagcagcaggtaattttatttaatttttcaaagcaatgagagactattggagtgggagcaggcatgcaggtaataaagaactctttgatttttattgaaacatccataatttaaatgacaggttttgcggattcaagactagtggtttgcagagggtgctctgcagagcctcttgggttccatgacattaccttggggcccactgagggtggtggttggaagaggaggaggctcctggctcccatgtccacatcctccactgtagctctaatttcataggttttgtatttcaatgttctgtgtgagttggcgtgaaaaatgagttctattgcaaaaatagttttgaaaacctttaatttgttccatctccacagtgtgtagatgaagaaacagattcaaagtagactcctgctctattttagtgattattaactcctggtaggtgtaagaatgcacaaaatgcttcagtcatcacaccaatcctgttacctaggctgagtaaatatcagcaccattgtttgccagattaggaaatggacactcagagggtttcaacaatctgcccacgagatggtatgcctaactcctagtcctgcttctcctccttctattccttctttaaagtactttttatctgaccaggctgtgtggttctctatgtttgtacatgttccaacccagagaagttgtagtgtataattgatagtattttaaaatgattccactgaagctgccattattagaaatgattgatctctaaacagcagcactatgtatgaatatgtccaataatgacaaactctaaccagtaagtgctcagaatagtgtgaaagttttatttagcaattttacaagattggtgtggagaatatatacaaattgctttctgtgtttttcttttttagcaggttttaataaatgatatatttataattttaaaagttatattaaagacctataatttgaacattgtagcattgcaagcataaatgttctttatgtttacaaaaaacctcaatggtattcttgattttaaattggtctttgtgtatattatattcctctcaagtgcactaaatttctatagattctgtatgttcattaaaaatatttgctcagttcaattacagttattgggattaggggtagcgggtggggaaaatgtgtaagttcctgaggcttccctaaatgggatgtcctctctgtggattgagacatgtccaaaaacccacatcgaaccttcaaggatctattacttgaggggcctgagagtctatgaaaaacaggcattttaagaagagtcctggctcaaattttgtttcatatctcgtcatatcaaaataaataagaataaaaaattacaataattgtgttatttttctatgtgaatatatatacacacagcagattttatttaaccatttcctctgttattaaggaacttaaaacatttaagatatttccgaatcttcgccattgtttaaaataacactgaaatgagcatctgggtgcatatgtaattgcattcatctctaataatttccattggaaagattcctattaatgacattgtcgtactaatttactctttcatcaatttaaaataatccttatactgccaaattttactaatattgaattatacattattttactaatattgctgatgaaaaattgtgtcctggtgactttttttcatatatctaccagtatgtttttgtcatctgtaagtggcatggagagcttataatttttgacatctctgatttatgtaaaatcatatatggaattagagaacctatgacattaaattaggttatctctggattgagaaatggtgatatttgttttcctcattctttttgtgagtttctgcccataaaatattttataataaaaatgcaaaaaagatgaaggtatctttttttacaaaacagcatacagtaagacaagattcatgtgtattatctaacatttatgaaattttattattaagtgtttttagaggacttattcaacatatgaaggattttagtcagtagacacagtgcctcttcacctgcactggaggcgttgtttttcttctctgtagcagggtgaatggggtaggatggtaaaaatttccactgagaatgtagcaaacttgatgtcttcaaaacagctccagcatttgtgagatgatgaatactccacatgaaagaggagacacagcgcagtggttagtgcacagccctggagtcgaaatccttagatattactccaggctttaccacttcttatgtgaccttgagcaagataaattttttatgcctcagtttcctcatctgtgaaatggggatataaacagaacctatatcttaagggtattataaagattaaatgaggtaactatgcagaaaacgtttagaaattctgacaataaattgttttaaaatggcaattataactttagtaagtggtctcatattctctctttttttaaaaattttactttaagttctggggtacatgtgcagaacatgcaggtttgttacataggtgtacatgtgccttagcagtgtgctgatcacggtcttcttatgcacatttaccaatttcagtttgttgaaagacacaattatcagatatttgaatgtggatgaggtttgttgtaattacaatttcacttgccttttgtgaatgtttctgtcacaccagggcatggggatgacatgaacaaaggcagagcagtggaaaagcataaacttgttcagggaatagtaaaaaatctaggtaaatccacaacataatgctattgtaacatactattaattatgttaattaaacaattattcatgtttggtcttcatgtcaagatgaaatatatttaaatacttgactttataacatatataatattgatgtaatatcataaaatatttgtaaaataaacacagttatataccatgtaaatatatttcatgtattcattctaatctaccgccaagtagtaaagtttcagatttttttttttttttgagacagagtcttgctctgttgcccaggctggagtgcaatggcatgatcttggctcactgcaacctccgcctcccaagttcaagcaattctcgtgcctcaccctcccgagtggctgggattacaggcgtgagccactacgccccactaattttggtatttttagtagagacggggtttcgccatgttggtcaggctgatctcgagctcccgacctcagatgatccgcctgcctcggccttccaaagtgctgggattacaggcatgagccactgcgcccagccttggataatttttaactctggaggagcagaaatgaagcactgtccggaataattttcctactagagaagcaagtgatgaccctgcgttacaaggggtttatatgctggcctagtatctatgttctctagatggcagtggtaggatctcactcccataacacccaagagtcactgcattataaggaacctagaattgctttcttttttttccgagaccgagtttcactctgtcacccaggctggagtgcagtggcgtgatctcggctcactgcaacctccgcctcctgagttcaagcaattctactgcctccgcctcctgagtagctaggattacaggcgtgtgccaccatgcctggctaatttttgtattttgagtagagacggggtttcaccacattggtcaggctggtctcgaactcctgacctcgtgatccgcccacctcggcctcccaaaattctgggattacaggcaagcgccaccgtgcccagcctagagttgctttcttaaaagcatccattatgtattagagaatacattacaacatttgcgatgaataatcaagcaaagattcaatatatcaccctgtttaaagtggaaatccacctccaatgattttgctgataatgatagaatgatataatttcaaaaatcattcttttaatttttgcattataaaaatttttgggccatgtgcggtggctcacgcctgtaatcctagcactttgggaggcctaggcgggtggatcacttgtggtcaggagttcaagaccagcctggccaacatagtgaaaccccgtctctaccaaaaatacaaaaattagccaggcatggtggcgggtgcctgtaatccaagctactctgtaggctgaggcaggagaaacgcttaaacccaggaggcagaagttgcagtgagccgagattgtgccactgcactccagcctgggagacagagcaagactccgtctcgataaataaataaataaataaataaataaataaataaataaataaatatttgatatgagtgatggactaaaaatctcaactaaatattcctgggactcttcattctgttctctaacagaaccttcaaagtgtattttggaaaaattccattaacacgctgcctaggctgaaataatttcatgatcagtttcatttttgcactcaccttgtaaatccagacctccaggcaggtgtcgggcagttatcagtggattaatctggtcagctgcttctggttgctgttttaaggttactacctaatgtgtacttttagagactctccctagtgtgctgtcacaaagaagtcgattggatttttatgtaaagaagggctcggtgagcctctaatccttaaatcattcctttgaccacattttatttcattgtaaatggagattaccacacagaggaatatctgatgctgtctggctgatccatttctaactaaacaattaagtcacttgtatgtcagagcatactctcagcaactggcatttccattacttcaggcttaccctgagactattttggaaatatttcatcttctgctattttttttctagacatttgttattttatttttagattgacagacaaaattgtatatcttcatctgtacaacgtgatgttttgaagtgcatatgcattgtgaaatgaatgaatgtagctaattaacgtatgcattacctcacataatcatcacgtttttgtggtgaggacacttaacatccactctctgagcattttgcaggaatacaatatattgttattaactctggttacaatgttgtacaatagaactcttcaatttattccttctatttaactgaaatcttgtaccctttgaccaatgtcaccccaagcaccccacctgcaactgcaactgcccccactcctctactctctagttccaggagattaatttttttacattccacatatgaaggagatcatatatttgtctttttgtgcctggcttatttcacttaacataatgtcctttaggttcatccatgttgttaaaaatggcaggatttccttctttttttatggctgaatagtgtttcattatgtttctatatgacagtttctttatccattcactgatggagtcaggtggattccatttttttggctattaggaataatgctgcagtgaacatgaaagtacaaataactctgacatactgatttcatttcctttggatatatacatgattatatccaccagtgggattgctggattgtatggtagttctatttgtaattgttttgagaaacttctatattgttttccataatggttgtactaatttttattcccaccaacagtgtgcaaggtgggtcattcacatcctggccaacacttatcttttgtctttttgataatagacactaatgggattttctcatacacatttaccaaacttcagtttgctgcagaacacaattaccagatatttcagtgggggcaagggttgttgtaattacaatttcacttgccttttgtgaatgtccctgtgataccaaggcatgggaatgacatgtgtagaggcagaacaatatcactccataaagatatcatctctcattgtgattttaatttgcattttcctgataattagtgatgttgagcatttttttcacataccagttggatatttgtatgtcttattttaagagatgtttatttaggtcctttgcccatttttaaattgggtttttcgttttcttgacttaagccccttaaatattttggctattaaccctttatcaggtgtatagtttgcaaatatcttctcccattgcgttggttgtttcttcactctgttgattgtttactttattgtgcagaagctttttactttgatgtaatactgcttgtctatttttgcttttgttgcctgtgcttcgggggtcatatccaaaaaatcattgcccagaccaatgtaatagagcttttcccctatgttttcttccagtagtttcatagcttcaggttttacatttaagtctctactccagtttgagttgattttcgtatatggtgtgagagaagagtctattttcattcttttgcatgtggatattcagttttcccaacaccatttattgaagagattgtcctttcctcactgtgtgttcttggcacttttgttgaaaatgagttggctggaaaagcctggatttatttctgggctctctattctgttccacttgttgtgtctgtttttatgcctgtaccatgctattttgattactatagatttgtagactattttgaattcaggtagtgaatacgtgctaattttcaattagcagaaagctcaagcaaaacaccctgagtataaatgaagcagctctttatgtggccttcacgaggattggactctcatagggcttggtttttgtataactcttagttttaactacatcctaaggttctagagaaaattctggagctgagacttagctatgcatttgtacaacttccttgtctgccaatctaaaagtcaatcttactgataatccctatttttcttttattcttatttcctcttaccattgtttagtagctaatatactatgtatttcacttgcttatgtgtttattgtctgtcaaccccatcatagctccatgagcatagcaccacgggggcagaaattatctactttgttcattgtcatagtcacagtgtcaagaaaagtgtctggcacattgcatgtgtataataaataattttgaataacagccagtcaccctattttatatatcctattttagtatcttggcatgggagataatttcatgagtatttatatatttgcaaactttggaagaaaaaaagaaaaaacactctatagaaggcaaattgagaggactgaaagtttagaagtgacaaacaacctagaaatagctacacatttttagtgatcaaaatcaatttttgtcattaatctggatttactaacttctcaaagttatcatggatgtaaaagtggctttaatctgctgatgctctgtggtgttctacaaaattgctaaattgcttttatgtgaaactggataagacataacccttctcctaccttttatattattttttagccatgagccaaatttttctagctaagccaatttaaaaaatattagaaatgcaaatgtattgccattgttctaaaatgtagttttaaaattccatttttcaaggtgggatttgtgattatgtgtgaggcgcttcattgtctctcagcacttcccaaccaaaatcagtccattttgccactcctgaggaaaggtctgctctgtgtgactcacagttacttccatgaatatttatcctgcctgtactgttggaatcaccttgagatcatgtacaattagttagggttgatagaattagtaatgttactggttgtgttacagcatctacgggtctcagtgaagtgggactcagtcccttctccccattactctattttctgtcccttcttgattctgcttgccattttgggggtgccaatttatttccttagtaaaaacaacagtagttatatattaagatacaactgtattatttgctttttttcttaaatccactattattttttgtcttttcattgattaaacttcaggcaaaactcatttggctgtgttgaataacattttgcaattttcttttccctgtgtctttcacactttgtagcattgtgctcatgtatactgtctttgtaagttcgaatctattaagtgatggttcgtcataaatcctgtataatacttgattttcatcatttatttatattttgtcacctgtactctcttgtcctgagtacaaagaatacacattcatctctgtaccttttttgtttattgatagtttatactttctttggacaacttttaaatgtatatttatttatatttgcttatccaatcttataaagaacaatttcacaagtagttagtccctgctcatcttcttttgatattcctaatatagtcttgtaatggattacttgggatatttattcctctgtattttaaaatcatgaatctcaaacatctctatccaccaaagaatcttttgaactaaaaaacgcacacagacagaccacatttttgaaggattcaatttcaaaataaagttagttcctacttagccttgcaaaatgaggtatcttctcttgataaagttgtgcaaataatgaatttcaatcattgaatattctaaaaatgtgttatcttgcctaagtaattgtttctatgcctttagctattaaaaatatgaaaacataatcctttataaaagcacatatttttaccttccatttgagtaatttttattagtcaaggaattttgtataggtatatatttggtgaaactttttaataaaattgtgtttttctggttataaaatgatgcagtttcattaaaaacatttataaagcagaaaaatacatagaatataaaaatcatccatattttcatagccagcaaatcattgttatcttaaaagtacatgtctataaacaataatttttaatggaattgggatcatttataagttcatttactacttgtctcttaacaataatgtataatctaatggttagtggaaaattcatcatatgatgttttcactatttaataaattcctcattcttagacatttagattgttttcatatttttcactgttatatataatgatgtgatgaacatttttgaaaataaataatcatagggttttctcttaactgccttacatacttcatttggagttaaatcactgagtaaaaagattcacatctcctcccacactctgccttctcttatgtgatttagtaccttttgcttgccttaatctctttctgcaaagtaagaaagtgatctgaaaaactaatttatatacagtgttgttaacttgtacgtgttttcctgcccctttcccttgctcagctgtcctagaccaattttgggaagcagactccacagacagaggtttatttgcaggagatttagtggggaatgttgtcagcaacaatacaattaagggagtaagggaagggggttgagcaggagaggctgaactcgggtgcaataacaggaaggtctccagccatcccaaggggagctctggagctcagaaggaccctcagagtgttcttgaattgaaatacatctctgaatccaacttcctcctgccactcccattgaccagtccttagtttggtatagggtgccttgggcaaggcagtggacatgctcagtagctgggtaagatgaggacttcatcccaaagtggccgtctgggcagtgaaccactgggtgttcagcgtatcagcctcgtggattttgtgttatcaaccaataaggggagagggggtgaagtgtaagtcaaaacagatgattctccactaggaaaattttagtctttcttgcctgttacctaaattggaaaatgtacatgaggaggatcttcctcagatcttgtcggcctctttctcataatcctgctctagaactcgaaatatcctgctctacgactcaaaaccaaacaaacattgttatttgttggtgaagggggcacctagaagcatttactgaccgagcagtgactttaacattattttatgtatcaatgtcaccagtttagaggatttcactatattaacaagtcctactgtgaaaataactatagtattactgattatataacaaggtgaaatactatattttgaccattaaactatttttttttaacttgggtgacatttagcaatttaccatttccagcaatctaaatgtttatgtcacagaaatcacatattaaattatctggaaatttatttctcaggaggatcaccaaggcatcagaaaataataataattaataacacaactataacaacttgacgttttataaggacaaagtatacaggttaatcactaatattgtaatttttttaacagccattgaactaaattttgacaattgaaaagaatttaattatgaactcctgatgatttgcctcccacctccaaatagtccacccatcattctttatgaaatatttattgtataggggctgggtgtggtggttcacgcctgtaatcccagcactttgggaggccaaggcaggaggatcacttgaggtcaggagtttgagactagtataagcaacagtgtgagatcctctctctaaaatatatatatataatttattgcataggaagtattttggggggatagtttaattactgttgtacctggttgtacttgatgaatattcacattttttctgctctctaaaatgaaaatttagtatcatttaacaacactaagagacatcatggaagcacaattctttattgccgtattttggaataggggtaaataggatgagagttgtttaaaatacattttactctgtctctcccactgagtgaaactatgcatcctggacagaatacataaagcagatatttgaggaatctaaaaaataaataatagcagatgtagtgggaagaagaccagaatttgttcattttttcctctggtatcttctggcttagactcaaggcagcctgacacctgagagagcaccttgtcatagacacacagctgcagacgccatttagttcagactcaaagagcatgaaagtgacctcttgttagtggcagtggtggcagtgaacgctctcagaggctttaaattctgaaggaagagaactttgatttgaggaaatctggtcccaagatggcagagcaaactttcatgctgtttttctatctccatcctcccatcacttagtgtggatgcagcggcaggaagtaggtggcagagaagggggtaaataaaaccccagctttttggctgcaggactgaaaagaggagctcctaggaaccagtaagtaggaaagagatagcacagagggagaagcttgggaaaggggcccaatggagttgtttacaaatttctgagctctttttacggccacagtcctctggtgaggactgatagtagaatagtatgcttgtttatgtccttatctggttggatgcagcctttattatttatttatttattcagcaaaacatcttgtccttgttggcaagatgctctgtgaaatgtgatggagtctttttctaaggcagagtgacttatgttcaaaggctctctttacatatgggctccttacttagttgctcagcatctcaggcttgccatctagaaaatggatagaattctcactaccgtcaagaagtgttatgaggattaaatgaattaatgtacactaagcaactgaacctaacaaatgtttctttccctgtggcatttggtttttagctttcctatccatttcctaagtatcaggcccttaggtttcatgtttagcactcctttaatctgtcaagtttactaagttgtaggataatttagaagcttcctaagaatcacatgttaaataaaaaaagaacaaaggtcttaaaggaaggagtgctaagataaaacctatggtaacctgctgccctttttcttacttctgaagagttgaggttgtcagaaaactaatatttagatatgggcttatctggttcataatattctaaacaacactgctaccattactattattaccaactaaaactatttaggatgtgtcaggtattgacattctacatatattaatttatttaattcttacaataacatgataaggtgggtaccattattattctaattttacagaatacataacaaaaacatcactttattgccctagtcttgttattcatattattaaaaaaacaactattgtgtactggtcttaaattaactataaaattagttaatatttggttatctctttaggataaaaactctagctaaaatgagccttaatatgggcaatgctttttttcctgctccataaaacagaccaaccctccttgcaagcttaaggctaaaaacccagaatgtaataacaactggaatgttggagatgcatcaaggtttttgcaatgtaaattccttccattaccttagttcaggtcctaagcttctctagtttaaattattacgattgatttctttttatttatttatttattggttttgagacggagtctcgctgtctcccaggctggcgtgcagtggcgcgatctcagctcactgcaacctctgcctcccaggttcaagcgattctcctgcctcagcctcctgagtagctgggactacaggcacctgccaccacacccagctaatttttgtatttttagtagagacggggtttcaccatgttggccaggctggtcttgaactcctgacctcaggtaatccacctgccttggcctgctaaagtgctgagattacaggcatgagctgttgtgcccagcctattacaattgatttcttactgagcataccaatctcttcttcattgactgcatactccaccctcactgcttgaattatttttattatttacatgcctggtttaaaaaataatggctgctcaataaagtaggacctttttctttcttttttttttttttgactgagcacaggggactttagtaataggacgtgacaaggtggagctccctaggcccctcccttttcaggtggtctgtgtggaaattgtgaagaggggagatcctcagtgttgtgaggtctgagtgcagcagggactccccagcagctgggggcctctctcttcctcttatactctcgctggggctggtggtccgggggccttattccttggaagccatgtgggccatgaggtccaccaccctgttgctgtagccaaattcattgtcataccaggaaatgagcttgacaaagtggtcgttgagggtaatgccagccccagcatcaaaggtggaagactgtgtgtcactgttgaagtcggaggagacaatctggtgctcagtgtagcccaggatgcccttgataggatcctctgaagcctgcttcatcatcttcttgatgtcataatatttggcaggttttccagatggcaggtcgggtccacgaccaacaccttggcagtggggacatgggaggccatgccagtgagcttcttgttcagctcagggatgaccttgaccattgccttggcagtgctagtagatgcaggtatgatgttctggagagccctgtggccatcaggccgcagtttcctgcaagggccatccacagttttctgggtggtagtgatgacatggactgtaatcatgagtctttcaacaataccagagttgtcatggatgaccttggccaggggcgctaagcagttggtggtacaggaggcattgctgatgatcttaaggctgttgtcatacttctcataattcactttcatcatgaacatgatggcttcagtagagggggcaaagatcatgacccttttggctcccctctgcaaatgagccccaaccttctccatggcggtgaagatgctggtggactccacaacgtactcagtgccagcatcgccccatttgattttggtgggatcttactcctggaagatggtaatgggatttccattgatgacaagcttcccattctcagccttgatggtgccatggaacttgccatgggtggaatcatactggagcatgtaggccaggtagttgaggtcaatgaaggggtcattgatggcaacaatatccactttaccagagttaaaagcagccctagtgaccaggcacccagtatagccaaattcgttgactctggccttcaccttcaccattgtgtctcagggatgtggcaggcgctgtgctgcacaagaaaatgcggctgtctctaatgggagaagggagccaaaatagggcttattctatgcttctaagaactgaatcctggcctcacttatttctctaatgctgtctcctctgactgaaagtaacaaacagaaagcccttgtccagtcacacaaatacagtcatcattcatgcctttgctgcagaatgtatctgtcactcttaattaagttgtgataataattttattgtttactatttattgaggacttacattgtaccagggtttgttctaagccctttatgtggacctattttatagataaaaaagctgaagtttagagaaatagtttgcccagcatcatacattctgtaagtggggttgctgagatttgaactctcggcattctaatacaagcctgagtttttagccatgatacatattgctacctgtttatttctcacattgaagaatggaaaggatcacactgacactgcaaacctaacatatacatcttgtttccaggaggcaataagataaattgcatggaaggtctgttgggaggaatttggatgttgttactgtcccttaccctgaaggtaattattaggtcttttgagcccagagcttggtaacagttgccagtgttgataagccaaaggtggggtattttcctttttcctctggttaaagatcaattcacttctttcatgttttctttttagctgatgataaaggagaagaataaaaggatgacagatgtgaatacttaatcacgttgcttaatattatggagtgacataaaaatatggtttgctttatctagacagatgtggttttataaaataatcatggtctttttgtttgccatgtagaataattatgcacaaaatgggagtgtacattctggaaaggtcatcttgacttttaaagggtttctttaggcattcatgattgtcactttctgatcagtatgggacaagttgggatacataaaactctattctgtgttaaaggaatatttcaaagattccatgtttaatgaaataaagtattgcctagaaattagagacttgtgattacttgcactgattcattctgaagttttctgaatgctcttttaaaaatctgtagctcttagtttcttatttctttcagatatcaagaaatgcggatttccaatgcacttagcttatgctcaatattaagtgaaataattaatttagcatgtccatgatgatactaaattagtaattcagggtagttaaaattgcagtggatgctgaactgatccaagaaacagtttcaaccttgtgaactggtttggaattagtagtctatcattaaatagtaattaaacatcaaaggcttgaaatggcccattatgtgcaacagaaagtttgtgtgttagaataagacacttgaattaatatatatttcataattttatatagcaattatgtggtgataaacagtataattattttattttttatgagttcattgtctacattttatattttacatagtagttatggagaaattgcctactctgtgatgataaacagaagactttttattatttttaaactcactttctaaaaatataacacaaaattggtttattttattttatttatttattttgagacaaggtctcactctgttgtccaggctgaaatgcaatggctcaatcttggcttgctgcaacctccacctcacaggctcaagtgatcctcccacctcagcctcccaagtagctaggactacagatgcaccactatactcagctaattaatttttttttttttttttttggagagacaaggtctcactgttttgccaaggctggtctcacactcccaggcccaagcgatcctctcatctcggcctcccaaagtgctggaattacaggcatgagccaccatgcccggctaattttcttttaaatccctatacagaatgtaatttgaatatggattttgtttttgtaactcatatttgaaaaatgtctcctttaaaaaaatcatacaaatattgaaagtatttgagattttttaacctaaatcaggaatttgttttaacatctgttatcagtcatctgaagccacaacacttggtttttagagccattccactttatgatgtgaacatgcatgatgcatgcaaggaagagtaacatttcatactatgtgcaaaattgtcaaaccttgtatctttggtatgtgggagattggggaagtgaaaaatgagtctgttttattaggggcagtggtatatcatggtgtatgggtcatcattgtgaatcacagggaaagtggcatagcatttgggattgatccacatgccaccagtaaatcttggcccaaatcaaatcgaaatagcacaggaattaagatagttaacatttggcagggcacggtggctcacgcctgtaatcccagcactttgggaggctgaggtgggcagatcacaaggtcaggagatcgagaccatcctggttaacacggtgaaaccccctctctactaaaaaaaacatacaaaaaattagctgggcatggtggcatgcacctgtagtcccagctacttgggagggtgaggcagaagaattgcttgaacctgggatggggaggttgcagtaattcgagatcgcgccactggactccagcctgggtgacagagcgagactccatctcaaaaaaaaaaaaaaaaaaaaaaaaaagctaacatttatcaatggttaattatgtacctggcacagttctaagtgtttaaagtgtattaaatcattaatcctcacaaaaaccttttaaaataaatactgttattaattagataccagcaggggtgagcattgtatagaggagcaaacaggtatggagtggttgagtagcttgctacacaactagaaagtggcggtgctgaaattgaactcgggcagtttggctacccagtcagcactcctaactattttattaaataaatatctccctcgggactttgattgaggtctaagtcatagaaatggtctgttttcctgaatttttcttcgttaagatgaaagttctaacttcctgccagtaaatgtctaatttatctggaatttgtatcttcaggatatttgagtcttagagtttgtttcattgtcccagtggtcagtctaatgttgagcttaagtcatttatgaattcagcccttttgtttttatgaagatgtagaaaatattctatggctttcttttccttttctttttgtagagacggagtctcgctctgtcgcccaggctggagtgcagtagcgcgatctctgctcactgcaacctccgcttccgggtttcaagcaattctcctgcctcagcctccccagtagctgggactacaggcacttgccgccacacccagctaaagaaaatattctatggctttcctgtgggttgctcctaagcttcctccaagatatttcttctttctcctctttccagaagcacagtcacccatctagcttgggctctctttagcctcctctgtagtaatcctaactctagtctccttacaatttattttctagattaacttaagcaatgttctgatcacaaactttactattgtctctccatttatcattatatacaatccaagtcccttaatgtgatagcccaatgtcttgttgctctggatctacctttcttttcttatcttaaaattcttaatcatcatggaagctaacatttattgagcacttactatataacaagcactgtgcttacttccaaacatacaaagatgaagaatagaacctactttctccctttgtgattatcacagggattatctcacttaatctttgtggaaaccatatgagctatgtaatattattaactccattttaatgaagaggagacaaagtcttgaagagtttatgtaacttattcaaggtcacaagagaaccatgtggtagatctgggattcacaccctcacttttaagccctatacaatactccccatgtcataaattttctaactctaacccatctttagacgtatggggctactcaccactccctttatatccctcacttttttctcttcattatcatgttttatgtcattttattctccttgtatgtaggtctcaatttttttccttatttctgcctattgagtaacaactgccttcaacctgtggatataattgacctctcccaccacagaaccaaagcttcatttattttcttaactcccatagtgctataaccttgtatgctgcttatacagactatatgatgagctttatcgagtgctaaaattttttttaagagtaaacgcttctaattatgtgtcataagtaagttctcagagaagctgattcagactttccaccaaagggttgtgttggtacagaaaacataaacatcaaccacattttagcacaattttcatcattctcttgtggtttgacttttctgatgatgtctaaacttagacataaaaggaaaccccgccttatatggatgacatggaatggaaaagaagctccatggctttcctgtttcactggtgggtttgaccttttccacacgtgcatttgctttgaactcctcctaagttaggtgctacgtgaatacaagttataattaacatgctttctttgggtctccttgaacaaaatgttctctctcatgatatgctatgcatatttactttgaatgaataatagttttgaatttggatttagaaagcagataatgtgactgaaatccatgtttcttctttgcctttaatctagggctgcaggatggggcccaaatgtgaagggaataaaacatgagagaaccttgtttagccacgagataaccagggataagagtttagcttataggctctaatcaaacgtgttatttttcattgaaaactggcgtatggtatcactatgcagctgttaaccagctgtttcctttctactggggttcttgtgtgctctctgctttaaatttatgtgttgcttgggatcccgaaggataaaatagtacttgtaggttcaaggtagtggttggaatggttgtttgcatgtttttagattttttagtttaaagcaacatgtttaaaatgttttcttctaattgctattgtgaatatgcaaatgtttatttaatcatgctcaagtgagagaagatatagaaacaattcataggctaattcaaaccatgtttttccctctcttgtttgccctacactaatctgccaagcctgtatgattgtctcagttctccatttagcaccgaagttagttttgaaccctgaaaaaagagacatttatatacttaattatttacatataataataaatatcgtggtcatgtaatggctacttcagtcattttatttccggaattggttccttccagtgggttcttggtctcgctgacttcaagaatgaagccatggaccctcgcagtgagtgttacagttcttaaagatggtgtgtccggagttcgttccttcagatgttcagatgtgtccagagtttcttccttctggtgggtttgtggtcttgctgacttcaggagtgaagccacagacctttgcagtgagtgttacagctcttaaaggtggcgcatccagacttgttcattcctccgggtgggtcgtgatcttgctgacttcaggagtgaagccacagacctttgcagtgagtgttacagctcttaaagatggcatgtccagggttgtttgtccctcccagtgggttcgtgatctcgctggcttcaagagtgaagctgcagaccttcgcagtgaatgttacagctcataaaggtagtgcagacccaaagagtgaacagcagcatgatttattgcaaagagtgaaagaacaaagcttccacagcgtggaaggggaccccagcgggttgccagggctggctcaggtggccagcttttagtcccttatttggccctgcccacgtcctgctgattcgtccattttacagagcgctgattggtctgtttttacagagtgctgattggtgcgtttacaaacctttagctagacacagagagctgattggtgcatttttacagagtgctgattggttcatttacaatcctttagctagacacagagtgctgattggtgcgtttacaatccttttgctaggcagaaaagttctccaagtctccagctgacccagaagcccaggcagcttcacctctcaatttcatgccttcactggcccgatgacagagtttcaccaacagaagaaaatctttcggtttgtcacagtgtgtatggtctgtggtcagatatgtcaaagaatggtaaacaaaggcctgtagacagtatatcagtgctatggtttgaatgtgtcctccaaagttcatgtgttggaatcttaattctcaatgccataggtttgagaggtgggacttttaagaaatggttaggttataagaccacatctggtctcatgaatggattaatgccattagtgcagcagtgaattagttgtcacaggagtgagttcctgatacatggataaatttggtccccttcttccccctctgtcatgctcttttgccttcctgtcttctgccatgggattacacagcaagagggtcctcacaagatacagccccttgattttggacttcccagcctgagccaaatacattcatgagccaaatacatttctttttttataaattacacagtcttaggtattttgttagagcagcatacaacagactaagacaattggaattcctactaaggattcacatggtatggagtttaaacataatggaatatgtttgtgttatcctttttattattggaaggttgagattttattattacaaggttgagattaggaaaataatacctaacaattataacacttactacacactaagttttctacatgtattaatttatttaaccttcttgataagtactgttaacatctttgttttataggtaaactgagacaaaacatgttaagaaaagtgtacatggttacacaacttgtaataatcagagaaggatttagatgttggtaggttagctctttactctgtactagactgccttgagttgttgcaaggagttaataattaatcagattactaatttcagaagtagtccagtggcatgtgcctctataattcctgtgtttggtatgtttgattaacttcccctaaacttttagaactctttttcatgattgctggggagcaccagtgtgggggcagcaaagcttctatctagaagatcagttaagtcaagataaggaattcacagtaggtgtattaggatatatcagggtgtactagtcaatgtcaaccaaatgcagagtgagttgagctgggattactatatcatgctccaacaattcaaagttttcatggggatctctcttttctgaaaccaagtctaaaactctcatacctctcatgtgaatttatgttaaatttcagagcattcaaagattttctcaccctaatgttcccttgaattaactagatcaaactgctgagctcataggaggggcttctgaaatatgtttgcttgtttgcttttgcttttggatagatggataagtggataattgagagaaagaaaaataaagttcatattaataaaattgtaacttgccatatttcattttgttaccaggaagtaatgacagtctttaaatgacttagtcttcctccaaggcattgtctcctgctaagcctcaataggcaggtagggaagagaagctattgagagagggagtgctctatagatagttttcttttttcttcctgaccacagttagcacagaatatggaatcatttaatctccatgttatctttggtgggggccaggaatataaggaggaacagaagctaaaataacaccaccaccaccaacacagagaagctaaaatgaaattactgagttaatgactgagtcctctataacagcaacttaatatattggctgtgtaggccatgttattaaattgtggttccagtgagtatcttagagcaaataactatagcaaaagtactattaaattcttagcaaaccaataaatccatacctgccagttaagggcaaaagatatctaatttacacatttaagatgtatacatgctacatttggtttcagagcattggtttccttggatttaaagtgcatttgtacattaactagaaaaaattggtagactttaacaataaggtgaaatactcaaacctgggaagaaatcagtaggctttaactataagtttaaagagccaaaacaagccaccaaatgaaaaagtgaaagctcatgtgtgctttacacatagcagacgtgctagaaataattgagtaaatgtagatggacatgaataggtggagaaaaacctatgaattaatggcaccaaaatctcaggttctacttggggaacgaggctctgccgtctggggaggtaaagtgagctagtaaaatgacatgatcaaccattgctaggataagctgtttagtcagaacactagctaaggtctcagctaaggagaatgagtaagtggtaatcatatttgagtaagtggtaatcatatttaaagactcagagatcaacagaagcaaactcctttattatttatttgttattattattggggatctcactctgtcaccccggctggagtgcagtggaatgagtatagcttactgcagtcttgaacccctgggctcaaatgatcttcccacttcagcctctcgagtagggtgtaaaccatcatgtccagtgcaaagtcctttataaggtggcatacttgccttgggtaaagacaaagatgaccagtgttggtgagcagtgttatccagtagatccagatgttttgctgtcaagatcaagaaagtaggtaaggcaaaagaacgggcccagtcagagcagaacacaggggctgcccttgggagaaaagtgggactaaacagcatttgggatcagaaaatcattttaatatgatgattcagggtattttactagcccactttcgaattctcttcacctaatcattataaagactcctatggctggtgattcagagagctcacaaagtctaaattgcatgtacaaaaggataaatgtaaaattttgcacttagcttaagaaacaagtggatgatgggtagggagaacaagctcagtcacactttgcaggaaaacaaaacaaaacaaaacattgcattaggaattttaaaatttaatcttaactgccacaagtcaactgtgtgacttttggcacaagatcttttaaaaccttaatttccttatctgagaaagaggatgttggaagaagatcgtctctgaggttcttcctggatttaattttgtagttctatggcgtcgagttttcttttaagtaccaattcatatgaagcaatgttgtgacatgtgatgccaaaaatctaattcattaggagaaatacagagactagattatcctactgtattcagtgtagtcgcttcatttggctggacaatcaagttatggttgccatatattttgaaggatattaaaaaaattataggagatctagaggaagttgactgaggtgtttattattgtagaaacaattgtatagaagaaaacatgagatgaactagggttcattagcccaggccagagaagaagggggcactcagtaactttcttccagtatcccctctcatagctctagatggaaggctgtaggaagattttccctaaaggctacataaaaagaaataaaaagacaaaccttcaaataattgcagtgttccagtagtaaactggattgctttgtgatgaaacgatttccctcacaaggatgatgttcaggcaaaagttgaaagaccatctctgcagggaaagctggatttgatgatcttgagggtcccaggcactcacaggtgcttccatcttatgatttgctcagtcttgacattagttttgaaattacaataaaaacaaatttatgtgctaatatcagaagtgataaatttttatggcaaactattttctgattaatcagaaataaaatattataattgtcaaaactcagacaatttcatttagttctatataaagaactattgaaaacagcaacatgatctggaggtttttacagttcctcttgctccttggcgtctttatccttcaagagcatttctctgagtgtatttctttcacatctaattctgtcttggtgcctgcttcttggagaatctgagttgacctagtaataaacacacaataaatattagcaattttctcttactctttcctctgtgactcaaaagcaatttgttttcttcctgtgaatagtttgtttactgttggtggatatagaattaaagtgagttagaattttatgttgtttttcctaacggaaccatggaaacgttcttgctgtttgatagttacaaaatgcctcctgattttaggcggatagtaacaatttagaattgaattgtaaacagcatttgggaccagaaaatcattttaatatgatgattcagggtattttactagtaaaaatacttaatatcacttagtatttagacttcacatctaactggactagatgactatttatgtgtagacaggacttagaggcggaacagcaggaggaaatgtagaaagtcaaacacctggctagggaaaagtccttacgctgtctggatttggtgtcagcctccgctctgtctccaccactagcatttccagccaatgcatccctgattactcaaagccaagcatttcctgcagagtagcaggagggataggaaacagcatgtgcttcctggtctgggaggtggcacaggactgcggggcagccagtaatagcaaacacctaaagcgggaaaggatttggtgaccctgtgaacagaactttgcttttcagcagaatgacacaatcatctgtagcattttagtctggatttaagtcataactactgagaacacactcactgtagaatctttgcttttggggcaccagtgtaataaggtagacaggactgatactgacttactcaggggagagaaacaaagatacacccagctcttccggagcatggggtgcccttggtggaaataagcaaacattatttttttgccctggggtcagttaaggtcattcaggaatcacttcattgagaaggacagtcttgaagagagtccaagagaaaaagcataaagttatgctttgagtggagggaagggtataatcattccagttaaagggaattgctgtcgatcacagctctgaagcagagagaatgatttgttaaccagggccgtgaacttaggtttacctttgaagttcttaaacactgtataaagctgcatattttaagaagtagagtgagccttaaatatttaaattatttaaatgtgtatctctcttgtagggcatgggaagaggaccatagtttctgtggcctccctaagatggcctgccacctctcctgatgctggtgacttcttgtgatggtggggcaatattaagtgtttgaaaaaggaagaagttcttattcccaagtgagagaccatataaacatagaaattaaagacaagggatttggatgaggtgtggatatgaattacagttttatttcttgctagtcatgtcaccctgggagagttacttcatctttctgagcttcagtttccttatgtaaaggaatggtgacaatattagctcctatcacaaaggatttttgtgagaattcagtgagatgtgccatgtacaatgtttagcacacagtgccagaaatattttatgggagcacagattcaaaaatgactaattagagcagttactgaggcgtctcagtgcaacagctgtgtttattattgaattgcctgcaaaaatgggcacacatggctttttaaaattttttattaaaagttagtaatttatgatggctttattaaaatacatgactagtgtaactggcttttatcacatagaacagtttatgttttcattagtgagacgaaaagaaaaagatttcctgcatcctgaattagagctatcatctgttaaaaatatttatgactaagaaacaaaagatacttgtttttacaagataggagctcaatatataattacaaaatgaatagattcacctatttattaaatacatatttgttttaaataatgataagtgctaatgggggatatgatagggattgggctgtgtgtgtttgtagatattgtagtgttctgaaatttagattgggcactagtcttaatgtctaaattccaaaattacttgaaaattgcaacttctattaagtgtgctcaacctaaaagtttccagaaggtttacgataacattcaagtttaaattcaacataattgcgaaaagttgtattttgtttattttcagagtttatgaactttttctgatgttttcctaatatatgaaaatgaaattgggaaaaaaagttagtttcagtaattggacctacatccttcagcgtggatttgtttccccgtttggctaatgtttcattgacctctacaaggctggcatttctagaataccaaccgagtaaattttagactctccacagttgatttttgttgaagctatcagaaaccatcaagaactcatttgataattataagtttttgtgtttgtatagtagttaatttgcaatcatgtgctgttttgttgaatgtttgaagttggcttgctattgatgtccttttctaggatgcattttccacatagaaaagaatacatgcctgagttctcaggtttatttgttcatttaaaaataatttatcaagtgcctatcatgtgctacatggttctagtattaaattgaaccccatgccactgtgggtattctatcctttttaactcaaaagtcagaaatttgatatagttcaacttattcaaaaacaagtcccctttaaagagctttcaatctaatataaggttttaggtgtataaaaaaagaatgcctctaaaagtttttatacttcattaaaaattttgtggccatggaattctaaaattctgtagatcagaaatatttctatataatgaaatatacaatgaaaatatttcagtataatgaagttatttccctgatgcaaggtctcatttagaagagtttgttttctgcatgaagcatccaaagtaataaatgatttcttcatccttgcgccgtgccgtatcatcaagaattacttatttgtccattttgttgtgatttttaaagctaatttagaatcaaaactgaagtgagaagttgaacagtagcccagttttgttcctgcttggaagaagtaattaatctttaacttcccgtatttctacctactctctttcaaaagcacaaataattttccttaccagaaacctcctaaatttcatagcattcacagtatacactgacatgatgtaggagaggtgacatgttatgtgcttgaattcagagttttttcccccgttctttttgatttaatgcctgaaaagagtagtggcatatggactctgttcttattcaaagcccaattatggtatgattcctggcaaaaacgttcaccattatacaagtccacaaagggctttgaattattgaccctactcagtaaacaagagagctccttgttgttggtcccactggggatgggggagcacaggcaaggtagtggaaggcataaaaaaggaaagcaaggagagatgaatatgcaaaatgctgttattttaaaccctcttgttttagtttacattcaaggaattgtatgtaatggagagggcacagaattaaaaactaaaatgatgggattccaagcaggctaaacttaaagtaccttcctaacgacaagcctacctgcctctgtacccattgtttccccctcccattttggttggaggtgacactccttgccattgggccaatcctcttaccaacatcagaagcccacttctttcttatcatgtttttatcatcctccttctcttctatatcttctccttctctctttctactggattttcctcatcagcatttaaacatatggaagtcttttaatttataaacatctctttatcctattttcccctcctgttaccaccctaatcctttccatctttacctgtgcataagaagtagcacagcaaggcaacacttgtctttactcaacagctccatttccttagctctcattcattaattaatcttcctctgaaagggctaaaccaaagttatcaatcatctccctgaagctaagttcgacaaacattaataagtttcttatcacttaccctcttatcaaagcacaacaaagctgaccatgccactccagtagatcctccactgacttggtttccatgatactagatccgtttggattgtctactgcctcttcagttgctccttctccttcttcatttaccagccagtgctcctcatctgatctgaaacgctggacttcttcaagcttcaatcttcggctctcttttcttctccttagaccaagatttctcaatagcttttgggtcttaaagaatccttgacaaaaaattattgctgaacttccagtatatcagcatgatcagtaagttgcagacataataaactaaaaatactattaatactcttttggagatagaatgatagttttctatggatatgtttattttggctaatattatcagcccactcattttgtgtggttctcctcccactaaggatatcaacttgaatgtaagtcaatagtatgagtagcgcaaactttagtttttctttttttttttaaattaaaatttcttctggatttttaaaaccttatccaattagacttaaaattcttattacaaatgtctactatgtaattagtatgtaatctcaacattttaggaggctgagaaaggaggatcatttgagaccaggagttgaaaaccagcctgctcaacatagtgagaccctgtctctacaaattaaaaaaaaattagccagatatggtagaacttgcttgtagtcccaactacttgggaggctaaggcagaggatcacttaagcctaggaatttggggctgcagtgagctatgattgtgccaccacactccagcctgggtgacagagcaagagtccatctaaaaaaaaaaaaaaaacaaaaaatgaccaaaaacccccccaaacccatacattctactataaaaaatgcaaacacggtatggtatgtggtacatggtgaatggcaagagtgctttttccctatttacaactaaagatgacttgttagctaacctttcttgaaaaaagaaaggcaataagcttagcttgtcttttaaaaatttaattcctttattttcaataattcttaaaacccatgggttaacatagtaaatttctgttaataaataactggcttaagccaaaataatttttaaattgtatttacttagaagcattcaaaatgtcaacaacatggctgcaactgtttttttttttttacaattatagagttgtattcagttatcaaaacaacaattattttgtataaactgcatcagagacaactgaagatgaaagaactaccatctccacatataactaatttgtgcagtgcaccagaaagaacctgtttaaatttccatgccaatttgcaacccccatactgtgccaggtaaggttagtggctattgaaaatactacctggacagggctatctaaagacacattggatagtgtgttaactatataaaaaaagacactgtacaatttaaaaacaaattttatacagacttacatttcaatttgtttctttaaaaagtagtcagttgtgtacaggggggttaaatgcttttaagacaagaaaaacactgcactagaaccaacttattaacattgtcattatctcctcctcctcctccttctcctcttcctcctcctccttcttccttcttcttctccctcttcttcatcttcatcttcttcatctttttttcatcttcctcctcttccttcttgttcttactccctttttttttggctacatcagtctttcctttagcttactgtgcagcaatattctttgggtatttttccttcagccttgcatccttctttttataaggctgcctgtcatctgcagcagtgtcattccatgtctctcccagtttctttgcaacaatggataggctgggatgttctctttcgatttttgggtgatactcagaaaagaatgaggccaaaggaggcctcttgggtgcattggcatctttgaacttcttttttctttcttctttaggagggacatgggtttcatttctcttttgtaacgagtattgtctacctttgccatgtcttcaaatttttctttcttcttggcagacatggtcttccacctatctgggcacttcttagaaaactctgagaaattgaccgaacatttgggtgcttcttcttctgctcctcccagcaagtttacacaaagaatgctgtgaagatattttgcctcttggcttcttaggctctcctttgcccaagtttagttatttttcctcagcaaggcacagaattatccagaatcacccagtgcccatctggttctcacttgccctggcattgtctttatgcagctcaatgaactacaactgagatttacttttttaaaggtaaacttgatagatttaattaaataaaatttgtcagttgaatttaattaatattatttacaacacaaagatttgttgggaatgctgaatagtaaacctcttaaaataataagtcaaagcagtggaaataaaaatacagcttaggacatatataaaagtcaaagtcttacagattgcttgttggaatgtaaaattgtgttgtcactttggaaaacagttctgcaatttctcaaaaattaaatataggttttcatgtgccccaacaatttcaccactaggtatatactcaagagagcaaaaacatacgtttacacaaaagaattgtacatgatgtttatagcagcagtatttataatagccaaaaattacaaatctaattgtttatcaactaataaatgaataaataaaatgtgatatatccataaaaaaaaaagtcaaagtctttagtataaagctgtaacaaatcattttctttgtgagtgacatgattaggctcaaatatagacctagaagttacaaaattgttatgcagatgtgtgttggttttccaatctcttttataggcctaaatatttttaaaagtattatttgaaccaaaaggaaagaatgaaatttacacatgtaatttcaaacttggtttttgctgcaaaaatactcaattctaggtcaaatatatgaagtaagcattcaactacttcattttcaactatgatcagacaatttctgtccttgtttttggtgtttcttaaataagaaaatgttgctcataaatcaaaaaagttgaaaaccacagcaaaatattcactgcttcactgtaaatggcaggatactctgtcttcacagaaacccagaactcatataggggcagaactcttattgtcatttgtaagaataatcagacttcatctcaaagttcttcctcttctctgaaaatcaagttctcatgtgaggagaaaatctagagaaagcatccctcaccaagtcagacacttggattgaagggaaaagtacactcagtgttgctctgcagttctctggatggttttcaatatgctcatatcctccttcaatttcaagcccaagcagcagttgaaacatttcacaatttccttctgtgacttgttttttcctaaagattcaatttctttaaattcaagaatcctgtcatttgaaacaaaaaaaaagtttctgggccatacaaagacttgttcatctggataaggtgatggaaaatggctgctaaatagcctagtttctgcagccattctttatcttgaaaccctctagcaaaatctgacctactaatttcttgaaagtgctacctttcggttcaaacaccctgttgagaactcttcctctgctaactcactggatgtagaataaggtttgttaggtggcctccaatattctcataccatcttcaagccatcttcagtgaactggtctgtgtttaatagtaatcatccttgtagcattactcagatttttttttttcattttgtatttaagagttttcaacaccagtagctctctggaaataagtcagtgtcttgtgatgtcagtgtgaaggtgaattttcttggggcaccatcaacgcagatgccagtgccattcttgcaaaatagactttctgttttcagatataaagatgaagagaaaaagtatcttgtcctttacttgttttgggcaacatcctgcagtagaaaaaaaatgttcttaaatttcaacattatttataaatcttacaagtgctacagcatgatgtttattggtgaaatttgtttattcatcaaaatggacaaagaagctgtaatttttcaatgtattataaaaataccttcagcatcatgtggcatgccatcagtatgtcagcttattatgctgattgagagcgtgactttttcagttgcttgtatggaatctcattctagcattttcctaattatgaccttacctgctatcattattaagttctcaccaactatgcaacttttccttttctaggctacactttgtgctttggataactccaaaataacttgttttcagagccttttccttgagtgtgactgttttttagaacaaaatatttattttgtttgtttgagattcaaattattgtttaaaataatcagtatctttatttgttaaatggctgtaatttgtagttaaatgtcttttcaattttgctagttattgctgcatttttagttgtttggtattgactgtgcacaatagaatagatcaacttggatgtaaaactcattgttaagtagctttcattgtaaaggtgaactttcttttggattctctgcactgggggagtgaattgactcaaaagattttatttccttatccaaccttatcaaaactgtccagaagcctaagcctagaatctttcttttctatctcatacttcatcttcagaaatcatcaacccaatgttcagatatatttgtgaaacacaaatgcagataaaatataaaacagaaaggtacagcagggcacagtggctcacgcctgtaatcccagcactttgggaggccaaggagggcggatcacaaggtcaggaaattgagaccagcctggccaacatggtgaaacccgtctctactgaaaatacaaaaattagctgggtgtggtggcacacacctgtaatcccagctactccggaggctgaggcaggagaattgcttgaacccgggaggggacattgcagtgagctgagatcatgccattgcactccagcatgggcgccagggccatactccacctcaaaaaaatgagacaaaacaaaacataacaacaacaaaaaacaaaacagaaaggcacaatacctgagaaaatctcaagaaatgcaaaacctacaatacagtctatttttaacttaccgaattcacattcagcacttattacaacaacaagcagcagggatcagatgagtcttggtatgtataagtatcttctttagggtgaaaaggtcccactgattgtctgttacacctgtagagcttatttttttccttgtcagtaggttgtatataaagggaggtgggaaaggtaacttggagggagaaggtggacatcattttcctgccttcctcacctttgtgcagcataacactcaacagatatccaaggcctccctcacctggcatcaatatctgagaatggatgtatctaaataaatattgtcctatgtacattaggacaaaatctgatgtttaatatctctgcaatcagtatttcacatggaagctctcgagacatttagcagcccactaggattctgtagaacttctgttgagaaaacttgttgagacaatcttacctacactcatggcttcagttatctaatgctttcaaatttatgtctcctgttggttctggatttaaaattgctgactcgccatctcctcttgaacatttcataggcacatcaaactcagaatgcctaaacttaaattctcaattgtgtctctactccctccccaaccatgcaaaaaagaaaattgtgagccacttccagtgttgttcccctcagcaaatggcaccaatgtccactaactgcacaccccagcaacctggacatcattctttactcatttcccttaactgtacctcctattccatgtttaatcagtctctaattcctgttgattctgtttactaaatgtcacaacattgaatcttattctatatccccaccactctgaatcaaactattcccttttttagggctgaatttccagaagagtctcttaactggtctttgttatctactatgaaaccagtccaagtcattctctactttgttgccaaatcttatcacgtttctccctgcttaaaacttctcaataactaccagcacattgctcttaagatgaagaccaaaatccttaataggacatacagtgatgtgcgtgatcatcccctgctaacctcttctctgccttctcccttcccttattgtattccatccatgaagacttatcaatcccctcttttaagaggctccctcacgctgtcctccctctgtttatacacctcccactcctttcatctcactcttactcatccttcagatctgagtttaaatgtcatttcctcagagaagcaagaagttccttagtactgtgtatttctgcctaatttcacttaccacaattctaattgcacagtttgttggttattatctatccctgaagcaactctgattgctcttgaaaggcagggagtgcatttgctgtgtttaccacctatctccagcattaacacacaataaaaacaattggtgggacaaatgagtaaatgaattattaaattcactaatttgcttctttcatgctattgctctcaagtttaggaataaaattactatactcattacataaaagaaatatgaatttctaattttagggttttttattagttgaactttttactataagcaaaattgcttagcatttgaaatacctttttaaaaaatgttgcctagtctaccatctcatgtatgttgtaagttttatgtgattaaataagttttgatatgcagcaaaataacaacatgaaattgtaaattatactaatagtctgtgacttaattagcatgaaaaatcttcccatttatttataagaccaaataaaaatattaacttgagattagcactgcagctgttgaatatttcagtgctattaaatattggaggacataatttaaaaatgtacaaagatcatacacagatcgttttatagttttatttttcttactattatttagaaaaagacattttgaaatcagtgtttcccacaaagaaaaatacttaaatatgtaattttaatacatgcatatgccaaaattaatatttatttatttttgtttggatataagccaacatagacatgaatgtagctcttttctcctgagatagaagaacacactattgaaattcaatcagagcatccagatgtaaatgagctgttcatctatagcccacaggatgttcactttggcttcaatccttccagactggatccataccaagactttctattattactattaattagcagttctggcaaaattaaggaatattgttatgtcagcttgaaatcctttagactgactagtgatctcaaaaaaagttaagacttgatcgataattattccaagcatgatgattaaaaattaaattcctgatgtgatccatgattttttttccctctctcactctattttagaaaaacagggtaggtatttattagagaggaatctaaaatcagaggtagaaaagggcatggattttaaggtcttctctgtcttcatttagtcttccctttctttccacagattatagatccagactcctgtgcctgaccactgcccatggccaactctctgctgatgactggacttgactacacaagttgttgggtactttgactagaacaccaaccaagtcattggaaatataatgctttgttctttctagctccaagatatgaacatgtgacaacccaaacaaacaaaatcccaacaaggttgtcagatatgcaaattacagttgacccttgaacaacagagagggtagaggtgctgatcactggcacagttgaaaattcaaaagttttgactcccctaaaacttaattactaataacctactgttgactagaagcctactgataatataaacgatttattaacacatattttatatgttatatgtattaggtactgtattataataaagtaagctagagcaaagaaaatgttatggataaaatcataagaaagagaaaagatatttactctccattgaatagaaatggctcatcataaagatcttcattctcaccatcttcaaattgggtaggctgaagaggagcaataagagaaggggttggtcttgccatctcaggtgtggcagagacggaaaacaatccacgtataaatatggacccatgtagttcaaacctgtgttgttcaaaggtcaactgtatttactttaaattacttgtctgacctgagattttcctgaccataatccaagagattgacacctttctaaagtttgttcttatgttttccaaaatgacaacttgttttccagaagttagcagccaccatgttttaagacagaaacagcctgaggttctcccaaggtctattgagcataagagttttttgccttctagtaaaataaacccatattcgcagagtgtctggaccagaaaatcttccacattatcctgtgttcaagtattaggattgtgcaatacatttcttagaagaattctgcctactactcatgcaaacaccaaacaggacaaatacaaaggcgaccacatctagacatgtcatattcaaactgctgaaaactaacaacaaaaaacaaatcttagaaggaaaagaaacctcgcatggggaaacaatgatctaaatgatagccaactttgcaggccagaagacagtgaaatgatacctttgcagtactgaatgaaagacaaagtcaacatagaattctatgtccaataaaaatatcctaaaaaagaaggcaaaataaaaacatttctagtaggcaaaagctgagagcactagtctttggtagatttgtactacacaaaatgccataaggaggttttcaggctgaagaaaaaaataccagttgcaacctaaatgaagcatgaagagtactagaaacagcgaagattaaagactattttaacatctttatttttaatacatatgtacctataaattttaacttcttcaaaaaattgactttttaagatataaataataacaatgtattgagctgcagcatatgtagaagtaaaatgtgggaaaataacagcacaaggaccagaagcatagatacatagaattatatatttaccaggttcttacattgtttgtgaagtaatataatattattttaatgtagattgggataacttaaaggtatatatctttaagatatcatatattctatatatcatatatatctttaagatatcatatattctatactgagcaatctataaaaaacaaagaagcatatctaaaaattcaatggatgagattaaattaaatactaaaaactactctattaacccaaaataagacaagaaaaaagggatgaaatgagagacaaattttgcaaatagaaaatcaatggtaggttataacccaatcatattaataattacactgaatataaatgaactaagcgctcaccccaaaaaaagtgattgtcagataggaaaaaagaaaaacctatctatatgctctttataagaaacatatttaagacagggtgcagtggctcgcgcctgtaatcccagcactttgggaggctgaggcaggcagatcacgaggtcaggagtttgagaccagcctggccaacatagtgaaaccacatctctatgaaaaatacaaaaattagccaggcatggtggtgcacgcctgtggtcccagctacttgggaggctgaggcagaagaatcacttgaacccaggaggcagaggttgcagtgaaccaagatcatgccactgccctccaatctgggcgacacagcgagactccatcttggggaaaaaaaaaaaaaaaagaaatgtatttaaataaagtgacacagtcagatcgaaagcaataggttggggaaaaaaaaccatgaaaaaatgaagtataagaaagctggtgtggttatataaatattagtcaaaggagatgtcaagacaaagattattaccagagatagagaactatatgcatgatgataaatggattgattcatcaagaaaacataacaatcttaactgtgcacctaatgacagagcataaaacaagaggtgatagataggacaaaaggagaaataggcaaattctcatttagttagtgtgatggtttggtttatatgtcaacttggctaagctacagtgcccagttatttaatcaaacaccaatttaggtgttgctttgaagatatgttgtccatgtggtgagatctacaatcagttgactgaaagtaaaggatattacttgatgatgtgggtgtgggttcacctaatcagttgaaaaccctagagtaaaaccaggtttcctggaacagaagatattctgcctcaagattgaagcactggctgggcgccgtggctcacgcctgtaatcccagtactttgggaggccgaggcgggctgatcacgaggtcaggagatcgagaccatcctggctaacatggtgaaaccccgtctctactaaaaatacaaaaaaattagccgggcgtagtggcgggtgcctgtagtcccagctactcgggaggctgaggcaggagaatggcgtgaaccccggggggcggagcttgcagtgagccgagatcgcaccactgcactccagcctgggcgacagagcgagactccgtctcaaaaagaaaaaaaaaaagattgaagcactaacacctacctgagtttccagcctgatggcctatcctattgatttcagactcgacagctcctaaaatcacatgagccaattcctttaaataattgtcttaatacatagatatgtatatcttctattgtgtctgtttctttggagaaccctgacttacatagtgctgttaacatcgctttgtctaagtagacaatataatcagtaaatatagaaaagatttgaacagcattattaaccaagttgatctaattaacaaatgcagatataaattatttcaagtactcatggaacattcataaagatcaacatgtgctgcatcaaaaaacacatctcaacaaatatcaaagattgaagtgatacatagtatattttgtgaccacaacagtattaaagtggaaattagtaataaatgtaagtagaaaatccccaacatttagaaattcagcaatatccttttaaataacccatgtgtcaaatgagaaattatgttggggattagaagattgtttgaactgattgataatagaaaacattataaatgggtgagatgcggctaaagaagtgcttacatggaaagttatagctttacatgcttatgtttaaaaagaagaaaggtttaccatcaatgacctacttctactttaaaaacctagactaaaaacttctctggtttccattgtaacatgtaaggagtttggaagtcattactgcatcctaacaacaaacaaaaagctgaaaagggcctggaaaataaaaacttgtctcagatctatcagagaagtgaggtcacagggcaaactactgtcctaaaaattagagagactgaatacagagaattacaacttaaaggagaagaaacccacaagcagaaacctccacaggaaccagtgctgggctatataaacctaaactctaattgacaaattcttagagccttagtgtagagaaatctaagagttaaaacaccatgggaacccagtcatatgggaacccacacaccttcatgagtttaccattcagagattgaccctattctcccagtagatattgaagaaaaatcctctcatgcttctgtcaggggaagggggaaagtaatcatttaaaagtataccagagcatgccattcttcttaacaaggcctgtcctcaggagaaactatttttaccagagcctaacctattggagtttttcagagcccaactgactgagggaaaggaaatattcaactctaccccactctagccatcctcttctacctaaaaggggagaaaagtgagaagcacatacaaacttcacagtccagaggcacaggctcactaaaacattgagtgctcatcacagtactaaagaaatctaccctgacccacactgtcccaccacatcactaaaggcctatttactgcaattccttttacccagtccatgttcacctttcaacaaagaaattataaagcatacttagaggcaaaatgtgcagtttgaaaaaagtaagcatcagacccagagttggatatagcaggatgttgcagttaccagattaggaattttaaaaaattatgattgatgtgttaaggactctactggacaaaatagagaacatgtaagaatggatgcatgatgtaagcagagtgatggaaattctaagacagaataaaaaagaaatactaaaaaaagaaatgctagagataaataaccctgtaacagaaatgaagaatgactttggtgagctcattagtggactggagatagccgagaaaaaaaactgtgagcttgaggatatgtcagtagaaactttcaaaactgaaaagcaaagagtaaaataccaaaaacaatgaaatggaatatctaagaaatgtgataaaactacaaaaggtgtgaatacatgtaacggaaatatcaagaggagaaagagcaaacagaagcaataattgaagcaataaggacacagttttccccaaattcctgacagatatcaaaccgcagatcccggaagcagagagaataccaagcaggataaatgcaaaaaacaaacaaacaaacaaaaaatacccaaaccaaaaaaaagcctatacctaggcatatcatattcaaattacagaaatcaaagacaaattcttgaaagaagtcataggaaaaaaataccttatctttagagaatcaaaagtaagaattacatccaattttctccaggaatgcatgcaagcatgaagagagtagagtaaattatttatggtgtgtattagttcatttcatgctgctgataaagacacacccaagactgggtaatttataaagaaaaataggtttaattgactcacattctatgtggctagggaggcctcacagtgatggtgggaggcaaaagtcatgtcttacatgcagcagagaagagaaaatgagagccaagtgaaagggtttccccttataaaaccatcagatcttgtgagacttactcactaccatgagaacagtatggggaaaactgtgtccatgattcagttacctcctatagggtccctcccatgacacatggggaattatgacagctacaattgaagatatgagatttgggtggggacacagccaaatcatataattctgcccctggctcatcccaaatctcatgttctcacatttcaaaaccaatcatgcctcctcaatggtcccctaaagtcttaactcatttcagcattaactcaaaagtctcatctgacacaaggcaagtcccttctgcctatgagcctgtaaaatcaaaagtaagttcgttacttcctagatacaatgagggtacaggcattagatagatacacccattccaaatagaagaaataggccaaaatgaaggggccaaaggccccatgcaagtctgaaatccaacaggacagtcaaattttaaagctccaaaatgatctcctttgacttcatgtctcacatccaggtcagactgatgcaagatgtgggttcccatggtctttggaagctctgcccccatagctctacagggtacaggctccctcccagctgctttcacaggttggtgttgagtgtctgtggcttctccaggcacatggtgcaagctgtcagtggatctaccattctggggtctggaggacagtggccctcttctcacagcttccttaagcagtgccccactggggactctgtgggggcttcaaccccacattttccttctgcacttccctagcagaggttcttcatgagggatcatccctgcagggaacttcttcctggacatccaggagtttccatacatcctctaaaatctaaccggaggttcccaaacctcaattcttgacttctgtgcacccgcaggctcaacaccatgtggaagctgccagggcttggggctttcaccctctgaagccacgacctgaaccataccttgaccccttttaaccacggctggaatggctgggacacagggcaccaagtccctaggatgtacacagaagaggggccctgggctccacccgcaaaaccattttttcctcctaagactctagacctatgatgggagggtctgctgcaaaggtctctgacatgccctggagacattttccctattgtcttggtgattaacatttgactcattattacttatgtgaatttttgcagctggcttgaatttctcctcagaaaatgggattttctttcctattgcattgtcagtcctccaaactattccaacttctgtctgttacccaattccaaggtcacttctgcatttttgggtatcttttcaggagcatcccactctactggtaccaatttgctgtattagtctgttctcatgctgctgataaagacatacccaagactgggcaatttataaaagaaagaggtttaatgaacttacagttccatgtgcctggggaagcctcacaatcatggtggaaggcaaggaggagcaagtcacctcttacatggatggcagtaggcaaaagagagagcttgtgcagggaaactccccttataatatggtcagatcttgtgagacttattcactattatgggaacagcacaggaaagacctgcccccattattcaattacctcccaccatatccctcccacaacatatggaattcaagatgagatttgggttgagacacagccaaactatatcagtgcattaaggattgtcatgtctttatggggtattgacccttttatcattttgttatgtccctctttatccctgataactttccttgttccgaaatttgctttgtatggaattacatagctactcctgctttcttttgattggtgttagcataattatcttcactcgttttcttttaatctatatgtgtctttatatttaagatgagttttttgtagacaacaatagtttggccttcttttttgatccactttgatatatatattttaatcagtgtatttagaccattgagttttaaaatgattgtcaatggatctggactcatatctaccatatttgttaatgttttctattcatttaccttgttcttattttgtcttcttttctgtttctgccttttgtggttttaagtgagcattttatatgatttcattttctctcctttcttagcataacacttgtacttctttttgtactttttaaagtgattctcttagtttgtaatatacatttacaactaatccaagtccaatttcaaataacactttaccacttcatattattaccagtactttgtaataaaatattccaaacttctctctcccataccttatattattgttgtcatttattttacttatacataagcatacataagtatcataagcttaaatatatctatatctatacatatgtacccacataagcatacataataaaatatatagattttttaagcaaactactatgttagatcaattaagaataagaaaaaataaaagtttgcattttacttccacttatttcttcttgatgctgtttttctcttttcatagatgagagtttctgaactatatcatcttcttctctctgaagaacttctcttaatgtttttgcaaggcactcctagcaacaaatgcactccatttttgtttgctgagaaagtcttgatttctctttcacattttcttttcttttaattcttcacttttgaaagataatttcacaaggtacagaattataggtggtggtggggtttctcttaacatcatgatatgatttggttgtgtccccacccaaatcttatcttgaattgtagctccatgagcggggctctcatgaagaatctatgctagggcagtgaggaagggaaatgtggggttgaagcccccacacagagttcctcctggggcaccacctagtgtagctgtgagaagagggccaccgtccagaccccagaatggtagatccaccaacggcttgcaccatgtgtctggaaaagccacagacattcaacaccagaccatgaaagcagctgggagggaggctgtaccctgcaaagccacaggggcagagctgcccaagaccatgggaacccacctcttgcatcaatgtgacctagatatgagccatggagtcaaaggagatcattttggagctctaagatttgaccaccccgctggattttggacctgcatggggcctgtagcccctttgttttagcccatttctcccatttggaatggctgtatttacccaatgcttatacctccattgtatctaaaaagtaactaacatgcttttgattttacaggctcataggcagaagggacttgccttgtctcagatgagacattgcactgtggacttctgagttaatactgaagtgagttaagactttgggggactgttgggaaggcattactggttttcaaatgtgaggacatgagatttgggaggggccaagggtggaatgatatggtttggctctgtgtcgccacccaaatctcatcttgaattcccacatgttgtgagagggacccagtgggaggtaattgaatcatgggggcaggtcttccccatgctgttctcgtgatagtgaataagtctcacaagatctgatgatattataaggggagtttccctgcacaagctttctctttttgcctgctgccatccatgtaagatgtgacttgctcctccttgccttctaccatgattgtgaggcttcctcagccgtgtggaactgtaagtccattaaacctctttcttctgtaaattgcccagtctcaggtctgtctttatcagtagtgttagagcagtctaatacgtgcacataaaaacagagtgtcaaaatatgtaagcaaaaactgatacaagtgcaaggagaaatagttaaatccagtattattattggagattttaacacacccctctattagaaatggacaggtccagtaggcaagaagatcagtaacaacagagttgaactcaacaacaccatcaatcaactggttataatggatatctattgactacttcatctaacaacagcagaatacacattcttccaagcttacatggaacattcaccagtatagaacatattctgggccaaaaaacacataccttaacaaatttgaaggaataggaatcatacaatcaatgtcttctctcagactgcaataaaattaaactagaaatcaaaaacaggtagttggaaaatccccacatacttagagattaaacaacatacttctaagtaacacataggtcaaagaagaaatctcaagataaaattttaaatactttgaactaaatgaaaatgaaaacacaacttatgaaaacttgtgggatgcagcaaacatctcacaagtttttaaaatgcgtaaagggaaatatacacagtagtacttcctcatttgcagttttactttttgtggtttcagttatctgtggtcaactacagtctgaaaatattaagtgaaaaattccaaaaataaacaattcttaagttttaaattgaatactgttctgagtagcatgataaaatctcttgccttcccacttcatcccctatgagatgtaaatcctcctttgttcaccttatatacattcactacctggccattagtcatttagtagcagtcttttttttttttgagacagggtctcactctgtcacacaggctggagtgcagtggcactgtcttggcttactgcaacctctacctcctgtgttcaagtaattctcctgcctcagctctgcccccctccccccagccccccaccgtccctgagtagctgggattacaggcaggccaccatgcctggctaactttcgtattttttggcagaggcggggtttcaccatgtgagccaggctggtctcgaatttctggcctcaagtgatctgcctacctcagcctcctggagtgttgggaatacaggcgtgagcagtcttggttattagattgactattgtgatatgaccgtgcttgtgttcaagtaacccttattttacttaatggctccaaagcacaaaagtagaaatgctggcaattcagatatgaaggaagccataaagtacttcctttaagtgaaaaggtgaacattcttgacttaataagaaaagaaaaaaattatatgctgaacttgctaacatctacggtaaaaatgaatcttctatccacgatattgtgaagaaggataaaaaaattcatgctagttttgttgtcacacctcatgctgcaaaagtatggccactgtaagtgcctagttaagatgaaaaaagcgttacattttgtggctggaagacagaaatagaaacatattctgatttacagcatttaggctgggtactatccaaggtttcaggcatccactggaagtcttggaacatagcgcctgtggataaggggaaactactgtagtattgaatgcatatattaggaaagcagaaagatctaaaatcaatcatgcaagcttttaccatagaaaactagagaaagggcaaattaatccaaagtaagcacaagaaacaataaatattagagtagaaattaaagaaattgaaataggaaatcaatagggaaaatttttgaaaccaaaagctgggtctttgaaaagataacaaaactgataagcttctagccaggctaggaaaaagaagggcacaaattactacttttggaaggaggagatttcacttcagagcccatggacattggaaggataataaaggaatactatgaataattctgtgcccacaaatttgataacctaggggaaatagatgaatttcttgaaaaataaaatctgataaaactcacacaagaagaaatagacaatccagataggcctagatctattaaaggaatggaattaataattaataaccttccaaaacagaaaccatgagaccctgatcagttcactagtaaattctaccaaatacttaaggaacaaattatatcaattctctacagtcttttctaaaatatagaggcatatggaatatttactaactcattctatgaggccagcttcaccataatgtcaaaatcagacaaaaacattatgagaaaagatcaatatttcttatgaatatagacacaaaagtcctcaacaaaatattagcagactgaatcaagcaatgtataaaaataattatattccatgactaagtgggatttatcccaggtatgcaaggttggctcaaatttgaaaatcaattactgcaatccatcacatctacagactaaggaagaaaaatgacatggttatatcaagagatgcagaaaaagcatttgtcaaaatacaacacctatttgtaataaaaactcagctagaattttagaggggaactccctcatcctgataaagaacatctacaaaacccctacaactaacataagacttaatggcaagaaactaaaagcttttctactcagatcaggaacaagacaaggatgttccttctcaccacttcttacattttactggaaatcctagctaacacaataagacatgaaaaggaaataaaagatatattgatcgagaagaaataaataaaacagtctttgttcatggataatatgattgtcgaggtaaaaaatctgaagaaatcaacaaaacaattcctggaactgatatgtgattatagcaagattgcaggatacaaggttaatgtacaaaatttaatgtcttttccatatgccagaaatgaaaaagtggaatttgaaattaaagacaaaaatcctttcagattagtgcatccccaaaatgaaatagttaagtacacatccaacaaaatatgtacaagatctatatgaaaaaaaactacataactctgatggaaaaaaaaatcaaggaactaaataaatggagagaaggccaggtgtgatgtctcacatctgtaatcccagcactttgggaggctgaggcaggtgcatcacatgatgtcaggagttcaaggccaacatgaccaacatggcgaaaccccgtctctactgaaaatacaaaaattagctgggcatggtggtgtgcacctgtaatccaagctactcgggaggctgagacacgagaatagcttgaacccgggaggtggaggttgcagtgagtcgagatcgcaccattgcactccagcctgggtgacagagcgagactccatcaaaaaaaaaaaaaaaagagataaattaagagatatttcatgtccatgcaaggaagagtcaatattgttaagatgtcatttcctcccacattgatctacagattcaatgaaattccaattaaaatcctgacaagttattttgcaggtatcaacaaacagattccaaagtttctgtggagaggcaaataacctgaaatagacaacaaaatattgagtgaagttggagtactgacattattcaactaggttacaaatgaaatgggaaaacagtttcatagttggctttgttctatagtttacattagggttaactctaagtgttgtacattctgtgggttttggaaaatgcataatatgctgttttggtgaaaccaaaagcagtaagtgagcaatatatgccttagcaatctatctttattaattcacatatttagagctgacttattcatataaagctttgcttcttataagaaataactggctttctctttaaaataagctgaagctgtgtgagattgtataaaacattatatattgactaatagggaaaaactttcttgtgtatacaggattttgtaattaaggttgaaaatgtaatctttaaacctgaaaggcttaaaaaaatttttagcccccacatgtaaagtgaaaatgtgatgtttgtctttctgtgcctgctttatttcattcagcatgagttccatcatgctcattcatgctgcctcaaatgacaagattttattatttttatgcctaaatattattcaattgtgtatatataccacattttctttatccattcatcctttgatagacagttaggatgattttatatcttggctattgtgaatagtgctccaataaacatgagagtgcaaatatttctttgacatactgatttcatttcctttggacacatacccagtagtggggttgcttgatcatatggtatttctatttggagttttttgaggaaacatcacactgttttttataatggctgtactaatttgcattcttatcaacagtgtaagagttcccttttctttgcatcccacttgcgtttgttattatttgtctttttcatatgaataatagccattttaactggggtgagataatatcttattgtggttttgataggcattttccttatgattagtgatgttgatcgttttttattatacctgttggccatttgtatgtcttcttttgagaaatgttcatccaggtcctttgcccactttttgatcaggtcatttgttttcttgctactgagttgagttccttaaatattttagatatcaaccccatatcagacatatagtttgataatattttctcccattctatagattgtctctttattctgttgattgtttccttctccgtgcagaaaatttttagtttggtataatcccgtttgtctatttttgcttctgttgcctgtgcttttgaggtcttacccaagaaatgcttgcccagaccaatgtcctgaagcctttccccagtgttttttctagtagtttcacagcttcaggtcttacatttaagtctttaatccattttgattttatttttatatattatgagagaaagaaatctgatttcaaatttctgatttcttttgcatttagatatctagttttacagcaccatttattgatgagactgttctttcccttatatattcttggtgcctttgttaaacatgatttggttgtacatgtctggatttacttctgagttctctattctttttcattggtctatgtgtctgtttttgtgtcagtaccatgctgttttggttactatagctttgtagtatattttgaagtcataaagcctatgcaactattatcaatctgggcacatggatggcattcaatatacattttttctttcttaagagtcattcaatcatcaaaatttgggaagtttttggtaaatataggactttaacttttgtgaaagttaaaaaagcaaaagaagatcttcccccaaataagaaaggatctagtgttggagagaacagaaacacagctgaaaatattcatgaaaagatgtggaacgtaagctcagggtcaaccaaggatattaatcagactattaaatgtattctcttctaattagatctgaagtgtgtttaccctgcttaaaaaagtggaccagctgataagtaccaaacaattctggagcgatataaagagaggcatcacccaaagaaggtcatgagttcactggaaaaatgaagtaacactgttgtcatgagtggccacagtaatagccagaagagattgaatgtgccttaagtttaaggataaaaatgtaattgtgatgggaggttggagaggaagctaggcctgtagccaaagtatggaaaaaaaaaaaaaaggaaatacagacaaaggtagcaatagagttgggtgatttaggaagctaggtctgtgaacaaagggaatgtaccaggttcctcccttcatgcggtgcccagggaacactttccagggctcaagtgccctctaaaggcatcactctgccaggttggactcagagccaaatgtaattgtgctgctctcttccattcaagtaggtgcctttgtttaacataagtgaccacttttaaagagctcagtcttcttggttccactcttgaactttcagtgttatcaacaaaaacctgttttgttttcgcattttcccctcagtgccttagcatggtgtcccaaacacttcttgatgatttttaatacttggattatacacataatgcccttctcaatctcccttttacttcccctcaaataaaataaaaaatttaagatactgcattcctgagtccaaggattgttacagttgtcacccccaaaattaggacaataatcacacaaattacaattcttctattcagaacataaatctgatattcttgagctcatttgataaatattaagtatcctcatatggtttctggtttacatacatttgccatgtataatatccataagccattctgggtgtgtgtccctattttataatctctagttgggagggagagcaccaagcctttaaattacgatctcatgcagaataacagctcagggtcaaccaaggataatgatcagaccattaaatatgttctctactgttcggatctgaagtgtgttgaccctcttaaaatagtggaccagatgataagtaccaaacacttctggagggatataaagagaggcatcacccaaagaaggtcatgagttcactagaaaaatgaagtaaaacttattcatttcatgtcagctgctaaaggatgtgctgcagggtgtagggtgtggcttaactgattacccattacggtgatcctaatagttttcatcaatgagaatattgtcaccgaatcttagcatttttgaaatgaaatgttgtggctctattatgtagttctttttgccagtctctgaaatcagttttttaaataacttacctctaaactctcgctctgcatttccttttgtttcctggatgtgaatgtggattcattggtagatgttaggcaaaggctaacttatcagtcatttctaggctcttcaaggtgaagcaatgcccacagacagtcttagaagggaattctgttctctcctttccttatttattcaaagactttcagattgtatttcactattactagagaattctttagtaaagctggatggattcttcaatgcattgggaacattcattcatggaaattggctctattgcagtgtttctcagacttgtgtatgcatacgagtcccctggggatcttgtgaacatgcaggttctatcctgtaggtcatttaatttcactgaatttgtgcaatgcaaaaagtccctttctgaacctgaatccacagataccagcataacctggagcctgttagaaaggcagactttcggatcctactccagatccatagaatcagaatctgcgttttaacaagattccagagggaattcatttgtacaaaatttgggaaacatcatcctgaaaatcacgtaggatcagctatgtaatggcaaaagcaaaagcaaacttatggtaccttctcttttttatgttattctctgattattccctgaggatgcagctgcatataatacggaatcattcatgtaaagagaagcaacctgtccaaaataccttcctttttgtattgaatcttgaaacagtgatgtcatttcctataatataccacatactaacagttgcaaattggtatctgagggctgtgtctagacagaagatatgttttgttggttattttgtttgtcctgtggatgattaaaaggcaatgttattgggcaggtgtgagcagttagcagctattttttcacatggagaagataatacagaggtgttatgcatagtatctataggcatttgagtctggaatccttaagagtaataattcccaacataaattccatggaacagtaatgtaagaatgattaacaggtattatttgaaaaaataaaaaaagtttctgtgatgcgttggcatgataaacagtgaaacaaaagaaatttggggggaggatattacagaggctttatatcataatatgcagtttgaacctccactgcaacatttctcaagcttatttactcaggaaattctgtgtctcaaatgattagagttctatagaacatactttagaacaggagtcagcaaactatagcctgcagactaaatccaacctgccacctgtttttgtactgcctacaagctaagaacagtctttatgtatttacatgtttaaaaccaaaagaagaagaatatttcattacacatgagaattctgtaaaatccaaatatcggtgcttataagtcaagtttttttggaacacaatcacactccttggtttacattttgcctttggcagcgatcatactataagggcagagttggcagctgagacagtgatcacatggcctgtaaagctgaaaatatctattatctgaccctttaaaaaaaagtttgccaacacctactttagagcacactgcgattcgattaccgcaactttttttttttttttttgagacagagtttccgctcttgttgcccaggttggagtgcaatggcacgatctcagctcactgaaacctccacctcccaggttcaagcgattctcctgcctcagcctcctgagtagctggaattacaggcacccgccaccacaccctgcttatttttgtattttcagtagagacgggatttcaccacgttggccaggctggtctcgaactcatgacctcaggtaatccacctgcctcagcctcctaaagtgctgagattacaggcgtgagccaccgtgcctggcctgcaattacttttgcaccaaccaaataaaaaggcctggcttcctcaaatgggaaatgataatgataacatagtgtcttttttgatgagtataagtgtactaacgataacattgtgtagcaaataaatattttctcttgtagacactttgaaatcaatgtaaaatcatatcaaatattcattttactacattataataagaattcctttctggggattaccactgttttcagacttttaagaaatagagtttagatttgataacaaatttttgcaattttcagttattacaacatgtgcctaagtatattttaagctgattaatcttttcaaactttttagtctcaggagccctttacactcttaaaaattattaagggcctcaaagaaattttatttttataggttatatctatcaatatttcagaaattaaaattgagagaatttaaaaaagtattacgcattttaaaataataataaaccattttatataaatatcaataacatatctcttgtgaaaataactatatttttcaaagagtggcatttttgaaaaaatctcattaacatctagtttgataggagatagctaaattctcatattacttctttatttaactgttgtgctattacacctcattaggcccctggaaaactccactcattctttgtgaaagaataaaagtgatctcaaaaaattttttaaaaataaatcgcatcaagtatcttatctgaccacaatgaaaaaaacctagaaataaataataagaggaccatgggacatttggaactgtgcaaatacatgtaaatgaaacaaaaagcacctgtccaaccaatgagtgaaggaagaaattaagaaggaaatgtaaacattccttgaaacaaacgaaaatagaaacacaacataccaaaacctatggggcacagcaaacatagtattaagaggcaagtttatagcaataaatttttacataaaaaagaaagatttcaagtaaacaacctaatgatatacctcaaggaattagaaaagcaagaacaaactaaattcaaaattagcagaaaaaaagaaataatgaagttcagagcataaataaaatcgagactaaccaaatagaaaaaaactcagtgaaacaaaaagttgctttatgaaaagataaacaaaattgacaaactattagctagactaagaaaagagagaagacccaaataaataaatgaaatcagatctgaaaaaaatgacatcacaactgatgccacagaaatacaaacgatcattagaaactattatgaataactatataccactaaatttgaaaagagggagaaaatgaataaatttctggacacatacaacctaccaagattgaaccaagaagacagagaaaacttaaacttacccataatgggtaacaagattgaatccataataaaaagtctcccaataaagacacgcccagaaccagagagcttcaatgctgtctaccaaacttttaaagaacaaataccaattgttctcaaactattccaaaaatttgaagtggagagaattcttccaaactcattctatgaggtcagcataaccatgataccaaaaccagatgaggacacaacaaaacaagaaaactacagaccaatacccctgatgaatatacatgtaaaaatcctcaacaacagactagcaaactgaatcaaacagcacacaaaaatttcaaacaccgtgatgtagtaggatttatcccagggatgcaaggatggttcaacatacacaaatcaataaacatgatccattacaataatagaatgaggaacaaaaaccatatatcatctcattagatgccaaaagagcatttaataaaattcaacatttcttcatgataaaaactctcaataaactaggtaatagaaggaaaatacctcaatacaatcaaggccatatgtgacaaacccatagctaacaacatactggacagggaacaactggaacaagacaagccactcttaccactcttattcagtatagcactagaagtcctagccagaacaattaggcaagagacagaatttaagggcatccagattggaaaggaagaagtcatattgcctgtgtttgcagatgccatgatcttatatatagaaaatcctaaaggctgtaccaaaaaactcttagaattgataaacaaattcagtaaagttgcagggtacaaaatcaacatgtaaaaatcagtagtgtttcacacataaactagctgacaaacaaatgaagagagtaatttcatttccaattgctacaaatacaaattacccaggaacaaatttaaccaaagaggtgaaagatttcacaaggaaaactataaaacacagatgaaagaaattaaagaagtgcactcaaaaaaggaaagacatcccaaatcatcccaaattcatagactggaaaaattaatatgttaaaatgaccatactatccaaagtgatctatatatttaatgcaatccctatcaaaataccaatgatagtcttcaaagaaatagaaaaaaaatcttaacatttgtatggaaccacaaaataccctgaatagccatagcaatcctaagcaaaaataacaaagctgaaggcatcacattaccagacttcaaaatatactataaagctatagtaaccaaagcaacatagtactggcattaaaaacagacacatagaccaatgaaacagaacccagaaccctgaaattaattgacatatacaaagccaactgatttttgacaaaggtgcaaagaacattcattgggaaaaagacactctttcaataaatggtgctggaaaaactggatatccatatgcagaagaataaaatcagatccccgtctctcactatatacaaaaaccaactcaaaatgggttaagagctaaatgtaaaacttgaaactatacaactgctagaagaaaacaggggaaatgcttcaggatgcttgtctgggaaaatattttgtgaataagacctttaaagcacaagggacaaaagcaaaagtaaacaaatggaattgtctcaaactaaaaaccttctgcacagcaaagtaaacaatcaacagagtgaaagagacaaccaacagaatgggagaatattttttcaaactattcatctcacaggagattgaaattcagaatatgcaagaaactcaaagatctcaatggcaaacaaaaaacctccaatcaaaacatgggcaaactatctgaatagataattttcaaaagaagatagacaaatgaccaacacatacatgaaaaagtattcaacatcactaatcatcagggaaacaaaactagaactacgatgagatatcatctcatcccaagtaagatgactgttatcaaaaagacaaaaaatgacaaatgccagccaggatgtggaggaaagggatttcttacacactgttggtgggaatgtaaactagtacagccactacggagaacagtatggaggttcttctaataaatcaaaataggactactatatgattcagcaagcccacaactgggtacttattgaaaggaaagacaattattatattgaaaagacttctgcaccatcatgtttattgtagcactattcacaatagccaagatataaagtcaatccaagtgtccaacaacagatgaataaattaagaaaatgtggtatatacacaatggaatactattcagcctttaaaaagaataaaatcttgtcatgcatggcaacatggctggaactgaaggacatcatattaagtgaaataggccagaaacagaaagttaaacatcacatgatctcatttctatatgggaacaacaaaaaaagttcttggaagtaaaaagtagaagagaggttactagaagctgggaagtgtaggggaaaaggggagatgagaagagatttgttaaagtatacaaaattacagctagaaagaaggaataagttttaatgtttgatagcactgtggaatgactataattaaccataatatatatttagaagtagctagaagagagaatattaaatgtttccaacacaaagaagtgataaatgtttgagatgatggatatgctaattgccctgatctgatcactaaacattgtatatatcaaaacatcaatatgtgccccacgaatatgtacaattcttatgtgtcaattaaaaacataaattaattaaaaaattaaaaaaactagttagtgttgagaaggatgtagaccatatgtaattttcacacattgatggtggaaatacaaaatggaacagttattttggaatacagtttagcagttctttataaagtcaaacatatatttaccatatgccccagtcatccatcttctaggtattcatccaagataaatgaaagcatatttttgtacaacagtttgttccagaagcttcattctagccacaaactggaaacaactcaaatgtcttatagaagataaatggataaacaaactgtggtaaatccatacaatggaatactattcagtaacaaaaaaagaacaaaatactgatacacataacaacatggataaatttcatttctgttaagtgaaagaagccagacgtaaaagatacgtactgtataattcttttatgtgaaattctagaaagcgtgtaagtatagtgagagaaagcaggtctgtggatgctcacagccaggaaagaaggggttacctataaagggcacaaatgaactttggggggtgatggaaatatcctataccttggtcgttgtggtgattgcacagctacatacattgatcaaaactcaccagacgtatacctaaagttggtcaactttagcctatataaattgtacctcagtaaagctgatattaaaaatcaatcacatggctatacagcagtgtgaatgtacttgatgccactgaactgtacaattaaaatgaataaaatggtaagttttatgtcatgtatattttatctcaattaaaatacatggataatatccctccctaaaaatgagagtgaaaaaggcaaataatgtcttagaattgttatgggccctctgaaggtgtgtcaggggcccccagggttccctgtaccacactttgaaaagtgttactcttttgtaactaagaatgaataatcatatacatcacacacacacacacacacacacacacacacacgtgcacactcatacacacgtttatactggtaaaaattatcaacaatcttcaatttaggaatgaagtgtttcaattgtttgcttataagtatcctgtttgcttgttgagcccaattgacttgtactaatagtatttcagaacccatctgtttaggtatttgtgattctgtgtataaatatagagagagtccaacctgggtgacaggaacatgactcccttcttgctgactagtaatggtgctggaacctctatccccgcatcactccttacctgttagtgaaatttgggatttcttcagccccaagctactactggggttcccctggccagggttggaggtaagaacctgatgaaaatagggacttgggatatgagtaggtaggtgtgaaaaacttttcttttatgaaatgcagggattagtgcaacatttttttcaccctcttgcttctgtgttttggatcaagtcctgtcttgttctctcctgtttccccatatcctcctatatttgttagacctcttacaattcaaactagcttacttaaagacaagataatttgttggttcacattccttgaaaagtccaggtataaaaggtagaggagctaacttcagacacgtttagatgtcatcaggacgttttctctctgtgtctctaaactctacttctctgtgttggcatcatttctagttaaactggtcctttccgtgtggtgaaaaataaggctaactgaatgcatagtcatcgtggaaggaaagaaacctgcttttttaccagtgattaaatcagtcccagattaaatgatgccagctggccaaccagggtcacaagccagtttcttagtggaaaaaggaagtccttgactggaaacccctccagaatacatggaaaggtgtaggagaattggagaagggattcaggggagacagcaagggaaaaatttgtcctgcaattcttgtttctaagtgaaatcaaggaccttttgaagttttctgaatgtctttgcaatttttaaattttcattgacaatttgaattaatttgctataataattaattgctttgaaggaaactgagaaatagattccaaactgtagataagatacagacttttagaaatgtcactcttcaactaacctagtattcttcaaccccagctaatcatggctgcatgctccttagcttcatgatcaatgtatgtagctgtctgtttctgtcttgatcatttctgaagctgctgtttccttatgttttctcaacacagaggctaccatgccttttttattgagggggaagctgagacttagtgaagtcaaataatttgtccaaggtctccattagtaagtgacattatagaactgaatccttttcaccccaagctaattttctttccaccataggctctaccttccaattaaacctcttgctagccaaatatgttctaaatttgtttattcattttccaaatatttattgacaggcactcttctggacactgagggaggatacacaatgaagaaaatagacaagttcttgttctcatggtgtgaataccctagcggaagggcagaaaataagcaaataaatatatatgatgtcacatggcaacactactggcaagaagaggattggaaaagtgtgctttttaattaggatgattaaagatgacgtctttgaggttacggttgaccagagccctcattgaagccaggaagcatggcagggagatagtgaaggaagggcatcccagacaggagaactggaggacaaaggctctgggtgtgaaagtctttggcatatttacagggaataggatagaggtggggggacctggaactgttaaggggttggggtggaagcagcaggagattaaatcagagaggtagccagaggaggttttatccagagagaccagagagatggcaaatattcaactgtgtgttctcattctctggaagaagaaaacactttatcattttacagtgcttaccttgagaatatgaaaaaagagaatcttttatcatttcagtcatctataagtgagtattcaaatttatatgttcaatcatttagtagttcattcttacagtcaacatttactaggcacccactgtaccctagatactccgccagatgttagagctatgaaaaaggaaaagagataccattttctatcctccagaaccagatgtgagtatgttgtatacaactggaggatgatcaggttgacaagagcatcttgtattactgtccacacattttttaccccccaaaatgtgtggtttccacaagaactagctggaagcctgccatttactgacacattgctacaaatttttaaattaaatgttttactagaaatggattcaatgtggtaacggatctgtctgactacgtttcagaagggtttaaaagcatttaatttccatgtcacatccattaaaagttaatgatgtcatgcactccagggagcaatccatttcataatttaaagtggaaccaacaaaacacgactcaaaagggaaatgaaggtgacaaggtacagaataacatgaaccagtgtagctgcacctgtcatgacccttcccggggttaacctggcagagaacagagagtttaagggaaatgaatcagagaaccaagccacattccatcttcctcagagagaaaagagcataaatcaggaagaaataaagtttatgtgatatgcagcacacatttttagcgttggtttccttcacactgaaatgaggaaaacagagcataaggaaagccacgtgaggggactgcataatgagctgtgggattccagaggatgtagatctccacgaaccctctgactccacacttgaactgtgaggccaactggcaccctccctccgtctccacactgcctgaggctctttcctgtgcctgcgcttctgaacaacagaggaaacccagggatacgctcttcccaatactcactcccctgcccttccagctccttccaccttgtttacatttgtactcgcgtatttcatgtgggttgtgaaagctggtaacgttatggctacagagtgctctattatattttcaagggcggaaaaaggctgtatgtgaagctgccaaatcaaatccttgccaaaatggtccaagctaatgagaaggtttgtaaattacagttcaatggatgagacgtggaggacaaggaatatcatgcccacccagcaaatagaatcactgagcatcactagcttttttactggtatatatatatatatatattatatatataatatatattatatatataatatatatatcttttttgcactatatatattttgcactatatatatactgcaaaatacatatatacatattttgcactatatatagtgcaaaaaatatatatacatattttgcactatatatatagtgcaaaaaatatatatacatatttttgcatgatcttagtcaaagtattcaaaaatttaagcatttatagagtaaagtttcatcaattcctatacatttaagctggaactagatcgggtgttacttaaactgacaactaatgcaatgttttatataatacagatgatcaataaatttctgcttaatgaaagaataggtgtctacaaaaataaatagacacatttagattgcagaaccaataattaagggcaactttaccatttgagtctacttcctgccccacttcctccccacagtaaagtttagaattttccacatattctgatatgatttaattttaactagtcctatcacttatcagctcatttctagactgattaatggacatcgaccaattttaatttataaattggtcttttccctgtttctttagattttggaagttttgtgtgcatttgctttggagccaaacacgagaagaaattttaaaaatcacagctctttgagtctttaaacatttttcaagttataaagtcatttagtttcagagacttttccattttctagctgaaagcaatcaactttaagaatccctatataagaattcctagaagtgcctggtcagaaaattaaagcagaggaagaattgatttctttgttatagtttccataatcatttaatcagaaacaatacaaaaaattaatccatttcttaaaatgtttacatgacactttctatgcatattcattaaaaagtataaaatatttttgtaatggatcaaaatttaacaaaatttaatttattttattaaactaagttttttctttaataaaaacaatcatgataattaagaaaatagaaagcattcaagttaaaataaagccagtaatattccacactatcaagcttaaaacatcattatgaaaattttgaagacgttaattttagatgtagggaatggtaattgcttgggctttgcctgcacatcagtagcaatgatagtcagatacaaatttagactttaacttaattcctcttttcctgcaggtcctttctcctgtataattatactcaatcattaaaaagaaatgaactcaatatcttaatatacatggaattactctgttgtatctacaagaagcacatttcctattttcaataagttgagttgaaaagaaaagaatgcaactttttgaattattttgtaaaatgcagttagtaaaagctttagtgttgctttttgtctttaatttgttttgttagttgtttctttctgtggtattcactatgatgcattttgtgttgctggaagctagtggtaacaatgcaatagacaaaaatacaggggagtaaagaatgaagggaacagaagaaaaaaaggaactatgagacttttcatgtgacatgttctagagctcagtacagagtactgtggagtttggttttaggtggagttacctctgcctattggagtcaggaatggcatccacataaaaaaaatgtatctgaaaaatgtccaaagcaatctacagattcagtgaaatacctatcaaaatcccaattttctgtttttacagaaaaagaaaaaaacaatttcaaaactcatatgggaccactgatgaccaccaatagctaaagcaatcccaagaaagaaggacaaagttggaggcctcacacttcttgatttcaaattacattacaacgctgcagtaattaagagtatatactatcataaagatggacatactgcccagtggaacagaatggagaacccagaaataaattcacacatatatggtcaactgatctttgacaagggtgccaagaatacacaacggagaaaggcttttctcttcaacaaatggtactgggaaacacacaaaagaatgaaattgtacctttctattatatacaaaatcaaatcaaatatattagaaacttaaacctaagacccaaaactgtaaaactccaagaaaaacatagggaaaaactttatgactttgtcttggcaatgacttcatggatataacacgaaaaacactatcaacaaaaacaaaaacaacatgagactacatcaaactaaaaagctcctgtgcagcaaaggaaacaatcaacggagtgaaaaggcaattgatgaaatgaaagaaatatccatgaaccatctatctgataaaggactaatctccaaaatatataaggaacttctataattcaatagcaaaaaaaccacatgacctgatttaaaaatgagctaaggttttgaatagacatttctccaaagaagatacaaatggccaacaaatataagaaaaaatgctcaatgttacaaatcatttggaaaatgcaaataaaaaccaccatgagattttacttcacacctgtccagatggatatcatcaaaaaaaaaaaaaggacaaaatgtactgatgaggatgtggagaaataggaacgctggcacactgttggtggaaatgcaaaatagtgaagctgctacagaaaatactatgaagattcctcaaaaaattaaaaatagaacttccatatatatgattcagctattccacttctggatatttatcaaaagagttgaaaccaggatcttaaagagatatcagcagcactattcgcaatagtcaagatgcagaaataacctaaatgtccattgacagatgaatagatacagaatatgcgatatatacattgaaatattatcagccttaaaaaggaaggacattctataatatgcaatgacatgatgaacctggaggacatcaagctaagtgaaataagccagtcacagaaagaccaatactgcattattccacttatatgaagtatccaaaatagtcagattcatagaatcaaagaatgaaatggtgtttgccagggaatagcaggaggggggaatagagagttatgaatcaacaggcataaggctccagtcaagcaagatgaatgagctctagagatttgctgtacaacattgtacctagagtcaacaatactgtattgtctgtttaaaatttgttaagcagtaagtctcatgttaagtgtttttaccacaataaaataaaatagtaaaataaaatgtacctgagatgagacttgcagtcctgtgtgagggacaggagtttgcccacagaggagagtgaagatggagagaatgttacagacaggccacagcctgctttgggacctagaagtgagtaaacaggctccctacaggatgtgcagacagctgggcctggggagagagtgccggggatgctctgagggccactgggaggtgaggctgtaaggcaagttgtggcagaccatcacaagcccttcatagacctgcaagagacttccaggtttatggtttgcctaacatgaggggctactgaagagttttgtgcaagacatgtgatgaagtatttgtgacatgataaaatgtcgtttcagccatcttaaaaccactcaaagttgacggtctcctctcctgcctcctgcggcttccattaccatggcagagactgtggtgtctgaggtggtgtagcgtactgaagcaaggctgtcttgaagaagaggagacaactcagtaagtatgttagtcagcataagctaggttatgatgcagtaacaaacaatgcttacatttcagtggcttagcacaacaggagggtatctctcactctttctggatgccctacagaagacagcgggaggtggggtgggtctgttccacagtgtcactcatggaccagactctgccatcttttgactgcactatctccaacacacgacctttttagtcaccacatcaggggagagacaactgcaagggtttgcagtggctcctttatgcttcacaatggaagtaacacatgccatttctttttgtagtcacagccaattccgtagctttgcctaaccacaggaggctggaagacggggtgggggggaagcagatgggtgcttgctgagcactgcagtctctgccatggtaatttcaggtagctagatggaagccacaggaggcaggagaggagaccatcagctttgagtggttttaagatggcagaaacatcaggccacagagactgaggcaatttggtgggggtgagagaggagtggcatagggtgattgctgggtactcactggtggcagcatactcagtgagcaaaactggcagagagtaggtgtagggtagagataaggctcatcttgaccagcactgctatctgcgaagcctaattaaacatgtccacggccggtcgcggtggcttcatgcctgtaatcccagcactttaggaggccaaggcaggcggatcatgaggtcaggagatctagactatcctggctaacacagtaaaaccccgtctgtattaaaattaaaaaattagccaggcgtggtggcatatgcatgtagtcccagctacttgggaggctgaggcaggagaatcacttgaacccaggaggcggaggttgcagtgagctgagatcatgccgctgcactccagcctgggcgacagagcgaggctctgtctcgaaaacaaaacaaaccaaaacaaaaccacaacaacagcaacaacaaaaaccccaaaaacatgtccactaggaactgcaagtcaggagtgcaaaatagagtcaggcctagctattgatatttggacatcatcacccagttataggcagaggttgaaaacatgtaggtgaatgagtctcccaaaggagagaatgtataataagattaggtgagagtttaaaaagttgaattgctcgtgcagtctggatccagagtcatcgcacccagatggattcaagaaatggagggtcagaaggtcagcttccacaagtctataattaactgggttttgatgtatgcttgcagaggctagagacacactgagagatttatcgagtgcaatatttgtttgacatccaaagaaataagacaagccttcttatgaactcttggcagagatttactttagatagcgaagaacagcttgacactacagattattagacaccacaagagtttattaaataaaatgggtggaagcattgattctacatcttaaatatatctctttggtccaggggttgtcaaactgtgtttcttaggggggtctcaggggctgctgcaggatgccaggagctggtgcagagcagagtgactcacgtcttccacctctccctccatcagctctgcggttactggttttatattgtaatgtttcacataagatttcattggagaaaaaattctgcaccacaaaaacaaaaagtttcctttccatctccaatgttaaaaagccttaggctgaggctttcatcatttcctgcttggatcgttgtatttttcttccctgggggtctgtctcgctgcctctgatctcgtccctttgtcatccaccctccgcatggttcccaaagtgatcattctcgaacacaaatccaaatctgatgttggcttctggggcatttttgacttcctatcaccaattgtagaaagttatactctaaagaatggccccaagaaagcatttcatgatttggccttcccttacctttctccagcccccttttcaggatgtccccttttgttccttgtgcctcagccataaacaacaactcatgcctgcagtgcgctgaaggtatagaaggcctttggtttagtgaatccaacttctcagctgcagcttcagcataatgacatcttagaagactccccagcttccagtagtttagttagaagtcctcctctggggctcctgtcatgaagaatgtgtacccctctgacagcacattgcccgcagtcttgtgttaattgatatttagtttatctccctactggataatcagcaattgccttcaggaaacggactggctcatcagctctatctcctcagactttggctctgcacttgaccctctaccatgttgttaaacaagaaatgagtgtcctcctttctggaaatcattaaaataatggttttttatctgctttattcatttgaaaagctttggtctatgaatatagactatacggctccttaagatttttgtctatattatttttgatttttttgttttttaacacctttagaatttcacagcctttataaatataatacttaaaagtaacatttcagagtatttggaaatactttttgactatttaaaacaaaatatgaaacatgaagtatagtaaagatataaaacgataatttagataaaaattctttctttcatggaaaacaccactgcattattcctgtttcaaatgtcctacagcattacatttttttttttttgcagcaactccactacacatttgttcatggtgttcacttcctacaagatacagtcaaaactccttagcctgatttccagagcctctgtaatctgacccaactgactttctcaaccacattacacactaatctttcacagatttttttttgctttatttaaaccttttcccctcatatttctatttattcttcttagcctttggtgaatgctttctatcagaggatttgtaccttcggatttttggaaaagtctgtaccattatatcttagcatattgcttatttgctgtttgtttatttatgtctttggaatttctctgaggcagatactagagcatttatgattcctaacttctgttttatatcctccattcctttatttttgtcctccatgtcacagagatgttctgttccatcttctaactcatcttcaagcatgatttgtcttgtataatccatttgcttagatttctaaagagatttaatgactgtacttacacttgacttttaagagcctgtttcataacttgctgtttttattttacagatgccatttcttcctttatattttaaatactgtaaacatacttattgtcagctctctttcatgttgttctattcttgttggttcctcatgtcctgtaagctgtctttcatgatgctaagtgtcctattttttaaaattctgttttattttgcttacgagtttacttcagaaggaagtatcttttctagagatccggataaccacctggggtggtttccactggtgttcctgtcagcaccttcaagacacactgattctgaattattttttgtgttagtttttcagcctggaattctgagtctattcctactcccacctgttgttcagtcttggggttcttatatctctagaagactcctattttacccacatggtggggctattggctcatttccagcagttatcttgggtatgcaggcagagatgatctggttccttcaaggttagtgcagtgctttctagggttctgattctgcacaggaagcccagttcttattccttctataaacatattttcctggccagcttctggccttgaatagccatgaaaatcccagactttgagacctgtaatctcccttagttccagatacattgtcatgttggctctatgttctagcatttggagatttcctttcttgcttttgtgttctgctatatatttaatatgtaaaaaaatgcttttaatccctatatctaaatgtctggaaatgttgtgttcaattccatcttatcctgttatttcttgactgtctgaatatgtagttcttatttctctcgttctctccattttgaataatctcccaaatgctctctgccttttgcaaattcactcattcttccaggacttgaggagtcactgaaggtaatgcttttttcctccagggaccaaattaacccctaggaagggtcttctatgaactcctttgacatccatttgacacttaatcattttctgttataattattatatggctattatttgttttcttgtgaaattataaaatctttgaaatttggggccatttcttaagcttcttgaatttcttcacctggtctcacaacaaattcttcctaatggaagaaaaacagaaaagaaagacacactaggatagagtaatttaaaatgttttagactttatttacgagggtccaagcacctaggaaaacaggatttgtttaaattttgcttactcattttattcaggattcatgaatttataaggccagagagatttcatataagatcctagattactaaaggaaaactgaaagattttatgtcaagcaatataaaattaatatgacagatgcaaccttagaaaatgtgtttcctgagattcctaaattagctacttttgtgggtgtctgcttagtatttggtcctgagtaaatgaataaacaaacagctacttctgagagctactttcacagggaaatgtttctgagttccagttcatgggagtttaggaaggtatgggatgcaaattacatttcaacactgaaccagccaatcaatccttgaacacttttgaagtctttagctttgcctgtgaacatgggaacacccaagggcaccttcaaattaaaaataaacatacattctaaggagtcctagatgtgtaatttggtagaaatttaaggggtgtctttttatagtaacggagtctataaagaaaatacaattcaggtgaggttacatcctttccagtcataaaagtgtatgtgaatgacatttaactcgaaattcaagtactttgggcatatcattcccgctccctgccccaatcccataatttcttggtagaaactcatagtgcatttttttttcagttccagccagatttttatatctattggatggatattacattaataaaaaaatagctaacacttattgtatgattgtctaatgccaagctatgttcgtataattatctaatatgttggtatgatttgactctgtggctccacccaaatctcacctttaattgtaatcccttatgttatgggaggaacctggtgggaggtgattggattatgggagcggtttccccatgctgttcttgtgatagtcagggagttcttaccagatctgatggttttagaagtggcaatttcccctatgcactctctctctctcctgccaccatgtaagacatgccttgcttctccctccccttctgccatgattgtaagtttcctgaggcctccccagccatgttgaactgtgagtcaattaaacctctttccttcatgaattacccagtctcaggtattctttataactgtgaaaatgggctaatacccagataaccctatggtgttgctgctgttattattcttcccttgcagatggggaaaactgagatgaagagttaattaatttaccaaagtcaaaagagtagtcttaaactactgtgaaatttctgtaggcctccttttttttccttcaaaacctttaatatgctaatacacatttttgtattttttttttaattatactttaagttctgggatacatgtgcagaacatgcaggtttgttacataggcatacacgtgtgattgtggtttgctgcacccatcaacctgtcatctacataagatatttctcttaatgctatccttcccttagccccacaccccactgacaggccccggtgtgtgatgttccactcccagtgtccatgtgttctcattgttcaactcccagttatgagtgagaatatgcaatgtttggttttctgttcctgtgttagtttgctgagaatgatggtttccagcttcatccatgtccctgcaaaggacatgaactcattcttttttatggctgcatagtattccatgatgtatatgtgccacattttctttatccaatctattgttgatgggcatttgggttggttccaagtctttgctattgttaacagtgccacagtaaacatacgtgtgcatgtgtctttatagcagaatgatttataatcctttgggtatatacccagtgatgggattgctgggtcaaatggtatttctagttctagatccttgaggaattgccacactgtcttccacaatggttgaactaatttacactcccaccaacagtgtaaaagcattcctatttctccgcatcctctccagcatcttttgtttcctgactttttaatgatcgccattctaacgggcatgagatggtatctcattgtggtttttatttgcatttctctaatgaccagtgatgatgagctttttgtcatatgtttgttggctgcataaatgtcttcttttgagaagtgtctgttcatatcctttgcccactttttgatgaagttgtttttttccttgtaacattttttaagttatttgtagattctggatattagccctttgtcagatggatagattgcaaaaattttctcccattctgtaggttgcctgttcactctggtgatagtttcttttgctgtgcagaagctctttagtttaattagataccatttgtcaattttggcttttgttgtctttaggcctcctttctattcatgtttctactttagaagacatatatatatatctacatatatatatattttatatatctatatatgccttctaaatatatatgtctacaaatatgtatgtcttctatattttatatatctatatatgccttctaaatatatatgtctacaaatatgtatgtcttctaaagtagaaacatgaatatatgtatctagaaacatatatgtcttcagaagacaaatatatatgtatatgtcttctaaagtgtgtgtatgtgtgtatgtttatatatgcgtgtatatatatatgtgtatatgtatttgtccagagttctcctggggaatctatattttattgagatgagaaggaaacgtggtagtgttggttaacttatcaccacctggttgctgtctaaactcaaccacttcctattgtgtcatggtttgattataaatttcctctaagcctctttttctggacactcgcttatcaccgctaatcctacatacaaaaggttgaatactggccactctgaaagttgacaatctaatatggattaaatgtaaaaataaagctagtgactccaaaacccaccactagctggttcatcacagttgtatatttttacactttctcagtccaccctctaacccaactcatcttcttgtaagcctagcacctattgttggctatctagtggcacactgcaaaggatcttatgtgcctggagccccggtttgcaattttttttttttttttttttttttttttttagagatagtgttgtatacttaaatcttgacaagcaaaagaaaaagaatgaagtttggaaaccatcacttctaaaaagcttgtattttattatttagaacagacttgcttaagggaaagataaaatcaatactttttccccctgttttcaataagtgcctagatattagattttatgtttgtttgttttaaacaacgttttaaacttgagagaattttgggtaagaaaataaataaataagttggatagaaataaaccttttaaaattaaattctcttcactaaagaatgtattactgggaaaggttttaaaaacttcactagaggtccctccaatttttttcacctgtttcctcaagatggggtagtcgaggacaaattgattactgttttaagcttccttccaaatttccattgctgttatttatggttctattccaaatgtaaaatttaggcctttccaatatttgtttttaaaatgaagagactttctgattcctatgaataaaaatactccatgctaatggaaaaatcaagaatcttggtgccaaagtgcttcattcaaactcttagacaataaaataagcaagacattaaattataacaaaggttccaaccttttactaaactagactcaccttgaggagcttataaaagtacagatttctaagttttcccaatctactctttcttcccatcccaagattctgaaattaattggtttggctgagcttgatccaacacattttactaaatatatatgtttattatatatagtctatattataaaataaatataattataacagaataaatataataaatatagtataaagtatatttattatataattatttaaggctgaagatcagtgtccacaaaggcatttcttgctctttgctaatgccagacaaattaatgcaaaagaaatggttggataagaagaaaggaaaatgagaaataatattcctatttataatttctatctattttcacaaaaatcacaagtagctaaaggtagtcattttgcctcaaattgccaatcaggtttaagaagttttttgtctgaatttcctaattctaagtgagagactgaaaatgcaaatgaactatgaccagaccacctatgacaacagaaccctgacccacaatctctgtggccaccagcccaggaagcaaaaccccacttctgtggccttcagcccagagtggtcagggcttggtcaatgactgccagctttccttttttttctttttttttttttttggcttctgcttccaactcaggaccaaggagagaaagccaaatatgttacccttctctaaacaatcacttaggatgccccacttctagttagtgcacttccagcttccctgaagccttcctttttttttttactgtaaaacgttcccattcccatctgtctttgagtctttgtcaaatacaggtgatggtggctgactcacttgctatggcaagctctgaatcaatagcttctgtttgttctcattttggtggtgtttatttagttccacatagctaaaaatggggaaaataaaaatgggaaaaaataaattatccttgtgcatacatgtaaggttatttataccaatttatgcaatttcagaaaatgagaggagaaagcagataccatcaccaaggcaagtgttcaaaagggcaataattacagtgacaagaggaatcccaataacttttattctcagtaaatatggctacacagtcaagagtgttgaggacctgagaatgggaagtcactgctttggctcctgtgattccaccaatacttgcctgaattctcttgaatcaatgaatcaggcgtggaagactagaagcaacaaagagaggagcaggtagtagagggggtaacttttagaaggctgtagagtggtcccttgatatccacagaggattggttccaggaccacccacatatacccaaatccatgcatacttaagtcgtgctattgggactttagaatccaggtatatgaaaagtcaaatgtgtatatgtgtgtgtatatatgtgtatatgtacatacatacatatatgtatatatatacatatacacacacatatgtgtatatatatatacacacacagagactttttccaaacaaaagcagatcaaaaatactgtatatatatatacatatatgtatgtgtatatatgcatacatatatacagtatatacatatatacacatacatatatgtatatatgtatgtgtatatatatgtatgtgtatatatatgtagtatttttgatctgcttttgtttggaaaaagtctgtgaataagtagacctgtgcagttcaaacccatcttattcaagagtcaactgtaatttcaatattttgtaacagtttagtcaccaatattgaagttgagagaaggaagttctctcttgtggacaatatggaatgctctaaaacttgaatccaaatgtacattcttggcatcactcaaataatgtgagcgtgtaacatttatgatatattcaagaggcaaaacccaattctttacactgtagacctgttttgttgttattttagttttgtgaaggcaaggttttaaggcaatttagttctaaaagcattactgagtatttactatttgcaattcactgcacttggtaataaactagagggagatgcagaaactctcttttctccaccaattcttcgaaggaaaaaacatttccattatcattaggtgacaatctacacagctaattgtacatatgaattgactgataatttacagttgcaatatggtgtcataaaaggagtcataaaactttgtgacttcgtttgctttttctctgtaagatatgtgctgcaaatgcaaactaacatcaaataaataactcctgtctttatacatacatgatctaatactttccacaactctgatatttaaggtacttccattatgactagttaattgcataaattcaataattaattatattctaatgatcaagaagaatatttatcaaaaataaaacttgcagacattggggaggaattaaggcatgttaacacattttctatatcaatcaggtacttttagtgtaaatgtgttatcaagtgaactggaacattaaatagaggaatttggtatcattgtgggaaaaataatctaatcacttttcaaacttggctgccctttggagccatttgagaaatttttgagaagcaagatacaggtattctaatttacttggtctgcagtgtggcccttgccaggtgatactaacatgtggcatagagtgagaaccatcattatataatctagaatttagtgtattactccttcaatattatacttctcctccagctcttgggacttttcctgatttcataggttggttgagcagtttttgttattgttgttgtttgtttttttaatgttgacttgttttcccaagtaggtattcttcctggaaagagatagtactcactataaataattaattgacttcctagtcaaattagtccttgatgagtctaaacagtgggtggtagacatatctcatctccccagtttgatcacgccatccgtccttaagataacagacctatagagctagtaggccaaccctagaaacaaaaaaggcaacagttatgtccaggtcattacagcttgtcaatttgcttctcccaaattactgcacttcttgtttcttcattgggttacacgcctgcttattcacgtccctcgatcagtttttcctcaatcctgggtacacaacagcatcacctggggagcattttagatgcctaatgcctaattacatcagtctctgggggtagtacccagttatcagtgttctttaaagctcctcagaagacactgtgaaccattgccttaggctgtagtgctctcaatatttacctaagacattcatgaatctgcattttctttagttgatattacagagctacagaccagctctgacccaagctcatttatataatggcagatagatactattaaaaacctaaaaaaaaatttaatagaagtctttggtaatgtacttacagagcccttgtactttgggccaggggctcttgtaagcactgtacatagattgaattatttattctagccacatcttacagatgagaaaatttcccagtgttacacacttagcgtttgggccaagattcaaatgaggcactctggctccagagtcaccagttaaccacaggtgaccagcaatgtggctgttaaaactactagatgtgatttgataggtgatattcttacacttccattttacaggtaaagaatcaaggtacagagaaagtgtcctaggatcacacagctagtaagtggcagagctgggatttgaactcaaaacagtcccaccctaaagatgatgttctgttaataatctagccttttttttcagacaaatattcaactgacccagctttccataaatttatattactgcagattggaatttggtattgcaagtttcatttgcacttctgaacttattcttcatgttttacccagaaatttattaaaaaaaaaaagaaataaaactggtggatttttcaccctactacaactgactgcactggagaagcaattactacagagatgctacagctgctttcttgatattagtccacggttttaaaatgtttttgatttgtaaatatgttaggcaccacaagtccgtcaagatggtatgtagaaagaagaaaagattctccactccaaatctttatgtgcctgaaaatccctttgatttcccttattagtttggtatgtctttaattttatattaaaaatacagatttcttccagttatgggacattgtcccacttcaaacttttaaaaacaaattaatcagaattttatggtaattgttatgtaaataggacaaatatatctcagccctttggcaagcagccttgacaactgaaacagtttcacactgtggatttcaatcaatgtaacaaagttactgagcacagtctaaaatcaatgaattctagagtgcaggagttttttaaaagtttcttgcttctcgcattttaatataaaaatcatcccaggctattgttaaaatgcaaaaatctgatttgggaggctttaagtgagatgctggacttcatatttcagtaaggtctcaagtgatgtacatgctgctggtctgtgaaccacactttgagtagcaaggacacagtgctggtaaactcgttctccaaaggaggaaaacaaagccttggcttgtagtatttgctaatttccatgatataaatgttcccacaaagaccacattcaagctaccaacgtgatgtcattgaaaatggagttgggaagagacattcagcacgctgcccacaattagctctccaaccaggtacaagccagttccagcacaccactgatctacataagtataagtacatgcaccttcaagatcccacaacatagctgtttcactctgcaaaggatttcaggaggtgagggagaataagaatgtcacaggaaaaaatgacaagattaattacaaagttttcagaataggtgcaaaataatctagttccaaggctatataggctgatgagagggcatgtttaagaagttaaaagacgtgtgtggccaataatggagcctttggggaagatctgaacccggtttggactgtgatgggtttggatgagtgggaaaggagaacacgcacagaaaaggaagtgggataaacactagcaaaatgtctgatgctaaacaaaattgaaggaaaacttggaattcctaaagagttgggagtacagtcattggtccagcagaatgagggcatcctgctttcacaaatgttttattctctggcatgattgaggaataacatattcagattaatcaaacatccaggttaacagagagttgacatatgtaccaaaaagagatgccaatgtttaaagtaatagaatatattagagtacacagaacctaatttctttcttctttgatgaagaaaggactttgagatcttccatgtctcagagccatggctttgagcacctttggtcccttctggtagggttctgtgatggagcctgcaaagttttgtttgcagtgtcctgtaagaagagtgtattttcaagtctttctctagggctgtagaatgagagcatcctaagaaactgactcccttggagagaatttctaactggcagaaatgctctgccttgtagtgcattgagtggttaaaagcccagactcatttccacatctgtaattggggctaataataccaatctcatatggttttggtgattattaaatgaaacttggtcaagaaatattggtgctcaatatttgaatgagcactacaaattagtgcaggcgttgtagccaggcatacaccgttactaatttttaaatcagaattgcttaacagacactgattgtctacaaggccataaacaggatgaggctgtggggagaaagtatggactggtccccaagcctgcagagctaaggtttctgcattctgcacacatctttgaaagaatctatgaccacctgtgcacaatgtttaaatgcctaggaaccttcccttgctacccagggagaggttttccctagaccctctgacagttccctcagtcagcaactatatgaaagaattttcttacatttctgaaatctgaatagaggtttatttgggaaaaaatccttttccctcctgtctcttggaataaatgtactatttcgttttcttaatttgtactatgttaagaaccagtagagggaacttaaggtcaatctgtctctcaggttgagtaactctaagctataagctccagaatcttgtctttgtctctaattccaaatgggcttgtggggaaaagtgatataaccatgagatcactgtgttcttttagatgatttcctgtttcctgtgtatttaaatacacagggaataatcccgctattaaaatgagaccctgtatgtgtgtatgggcagaagttcaatgaaaaaggaagaaaaatatgcttgctgaataccagatgtagaatgcataaatcctgtcagaacaagtggggaatagcttttatggctgacttgcaagaaacctaagggaattgggaaatcagataggcatgtgtcaagcagacttatttaaatcatccacttcctcagcaaaataaaagtttgagagggttctgcttccttttgtggtttgaaattacagttgtaggcctcagaagtcctgcttgattgagggcttccaagcaaagacgttatacaacctagttcaggcgcccgacaacactggggtcacccaatgcctctccctgaggtctccaaccttgccttgtttgtactttgtgtcctttgtcatctcagaagcaaattgtagtgcagctgaccactgcttcatggacctccagcttgtccctactaaaaggcttttgcatctgaaagagaaagatgcccactggcttccttcttagaccactgctgtagatcctgagcacaaaccttagctctgcaggcttggagaccaggcaatgctttctccttgcagcctcattctgttcacagttcgcacagggtttatggccttatagacaatcagtctgtggtaagcaattctgatttaaaaactaataatctgtgtatgcttggctacaaggcccacatgaattcgtagtgagagataaactagataccaattatttccaggtataatatcctaacaggtaagtttttcaggaggccacattgtagttcagcaggttactggtgtgtatagatacaaagcaaaggtatttaagtacaaaccatttcctttaaggtgtggtagctccctaaattgttcttctcaggatatttctgttttaaaatgtcctgttaaatatattatttttatgtacagtataattttttaaaagcatgctgacatgggaaaatcatggactttgcagacccaggtttaagtcattccaaatctaccacttactgatgtgtgaacttcagcacgttactgtacctctttcagactcatttccttatcttcttgctgagaatgtgtgtgtaaaaatattaatatggaatctagcatggtgtctagccctttgtgaaaccctgacaaattcttattcctcaccattcatctgttcatctgtattagtttgttttcacggtgctgataaagacatatccgaaactgggaacaaaaaaaggtttaattggacttacagttccacatggctggggaggcctcagaatcatgatgggaggcaaaaggcaccttttttttttttttatggagtttcactctgtcacccaggctggagtgcagtggcacgatcttggctcactgcaacctctgcctccagggttcaagcaattcccttgcctcagtctcccaagtagctgggattacaggttcctgcctccatgcctggttaatttttgtatttttagtagagacagggtttcgccatgttggccagactggtctcgaactcctcacctcaggtgatccactcacctcggcctcccaaagtgctgggattacaggcatgtacaagtatgcccagccccaaaaggcacttcttacatggcagcaacaagcgaaaaatgaggaagaagcaaaagcaaaaacccctgataagcccatctgatcttatgagacttattcatgaccacaagaacactatgggggaaactgcccccatgattcagttatctcccaccaggtccctcccacaacacgtgggaattatgggagtacaattcaagaggagatttgggtggggacacacagtcaaaccgtatcactacccatccatccatccattcatttattccttcactaaatgcctgttgaacaccttttatgtgccaaccactgtcagttagtggaggcacagacaaaagtgagaggtgaactcagttgatggtatgtaggtgggtctatttctgggctctctatgcttctccattgatttatttgtttatttttttctctttgtttgccaaagactttcttaatctttaacaatgtaattccagtgagagaaaaagaagtttcagaagtaatataccaaatcatgggatgggactgtgggggtggtgagtgagttcaggagagtgagtgagttcaggagagagagagagagagagagagagagagagagagagaaaatgaaggccatataaggtaaagtgttgaatgttacgtgctctgttgactgtgggccccaggatgtgtatgatggaatttactgaaacagaatttgcacatttataaaaaggatgcagttttagaaaatagctagttatgctagcatcttgtttcttcattgatgctgcaatgttatataagcactgaatcctcccacatttccagctcttatctaaaagccagaatgtgtaccacctgggttgagaggaagatgaaatgaaattggggaagtaaatggtaaaaagcatcctgaaagaaaccaactagatatgttcaagtcagcaggttatttagtattttgagttatttagtaatttgagtaatgtgtaaggggtgtactgacatgctttttctctcattttctccctgttctgcctgtagcaattctaccacctttgttgacctcttcttccccccaacttattgctgtagaggctacctgagctcattgtccctggagatggaccaaatagaagaataagcagtgcctgtgtggtgagcttcaagaggcatctgttctctggggagtgggtgggtggtaaagcaaagacgggagatgtgtatattagctatccattactgtataattaattatacacaaaactaaactatacactaaactaaaacttcacagcttaaaacaggaaatatgtattatctcacacaatttctgagagtcaggaatctgaaaatggcttagctagtttggttctggctcagggtgacctatggagttgcagccaagatgtcatctgggactactatcattggaaggctcagctggggctggaggctacacttccaagatggctcacttatagggctattggtgggaggcttcagttcctctccacatgaaactttcctcatgccatggaactggcttccctcagagtgaaagacccaagagagagactaagacagaagctgcaatgtttttatgacctagtcttggaagtgacttactgtcatttctactgtattttattcattagaagcaagtcattaagtccagcccacattcaaagtaagaggatttaagctgaacctcttgaaaaaatggtatcaaagtatttacggacattttaaaaactaccacaatacatataggtgaacttcacaaggtgtagacatgggctgagacagaatattggataatatctcattctgcaaacagcagcctcatctgtaataaaatcccagcattcagaaattatcacgatcaagtaggaaaagggcttgttggaaaaaacttatcaaagatgttacttcatttatccatttattctgagccatagcataatagcgacaaattgtgtgtcctgtgtaatttggatacctctgctcaataatagctgaacagattttatcctatttttagaatagttaatatatacacatggcacaaaatttaaaaggtataaaagtttctggttcaaaaataagattccctcattttctttttttctgattctttgaatgcaattcgatttactgatttctcatgtagccttagaaagtattctatgtacttacaaacatatatgtacacatattttttctttcccacaaataaaatactgtatgcattgttttattcttggctttttttcaatggacagtatatcttcaaggacttctacaatagcacatatagacctgctttatctttttttaaatgtctgtctagtactgcattatatttatttaagcagtcatctattgacagacgacattaggttgtttccagtctcttgttactatggacaaagctgcaatgactatctctgcacattcatcatttctcacacaggagtagaattcttcttcatttgtaacattgacagatattgacaaatttctctccaaaagggcttaccattttgctctcactacaatatgaatgcctgtttcttcaacccttggcagtacaataggttacccactttttgatatttgccaattaggtaggcacaaatggtctgcagttgcagttttaatttttattatctttatgaatgaggttgggcctccttttatatgcttaaaatcatctgcatttgctttactatgaattatttgttcttaatctttacccgtctttatattgagttggtgggtttttattttccttactgatgagtgggagttccttaggattaaagaaattagctcttctaaagaatcggtatacatggacagacagagtggaataataaacattggagactctgaaaggtagggataaaatactgcctactgggtacaatgtacgctatttgggtgatgggtatgctaaaaccctagacatcacctctatgcaatacatctatgtaagaaaactgcacttgtacctccaaatctatttctttttaaaagaaattagctcttcatctagagtgtgagtggcacgtattttttcaagtgtgttttttccatttgttttttgactttttattggttttctttttctttttccatgtagtaattttaaaaaatatttttctgtggtcacatttatcagtttttttctcttatagtttctgggtttgcatcattcttagaaagtcttcccactcctagggttactaagaatcctcttaaggtttcttttagtaccatcataatttgatttttacatttcaaatttgactgaattggttcttttaatgctttacactctaccgaagtataaaatactgcactgaccatgtttgttttgtttctggttcagatatttctagtttattctcagttttcttcgtttgtgaaatagagataataagtattactgagtaccatccatgacttttagtggagagatgccatcttgatgactgaaagctaaaccagagttttcttcctcattctcattacttagaaacctttgctgatgattaggtttggtgccctaatgggacaattgagactaacacggtctataagataacttgcttcaatttaaaaaggcaaaatcaaattagccatttcatatctgcctacataggggctactgctttcatttgtaatgtttaattacatttttttccccaagaatacatacacacggctatcacttctaaaataattttggctccctatgaagcagaattggaaagtgtcttaaagttagttttgaattggttatttggaattcaaaatgatacttcattaaaacaataccttaaatattggttaggttcttgagccttattacaaattccatacttatgtatttatgattcagaataggaggaatggtgctatgtcaatgacatgtaatgatatttaataacagtgtgtccctgttaatatgtgtctgagtggcatatcaggaatcccaaatatgtcttccccagtccttcccgtgcatcctagcagcagatgtgagaaccccaatagcccactgggaactggttgcaaggccagaaaggacactctggtcaggagaatacctctttatattagtaccagggaaagctgttttctaatatttggcagttgtcctgaataggataactagagaaattaggtctgtggtgtagaatttcagaggcgtatcatattttttcttggcaaataatatggttttgctgtatccccacccaaatctcatcttgaattgtagctcccacaattctcacgtgttgtgggagggacctggtgggaggtaattgaataatgggaatgggtctttcctgtgctattctcatgatagtgaataagtctcacaagatctgatggttttataaggggaagttcccctgcacacactgtctcttgcctgctgccatgtaatacgtcccttgcccttccgccatgattgtgaggcctccccagccatgtgcaaccgtgagtcaattaaacctcttttctttataaatcacccagtcttgggtatgtctttattagcagtgtgagagcagactaatacagcaaacaattagctttagggaagctggcaagcatgaaatagcgtcttagccatcaaggtgggttttaagggaagggaggtcctggagaagagaaggcagaaggcagatccccaagacaaggattcagccatacacagaaagaagatagcaatgtaggtgtctggcatgggaagcaaggtgggaattgaggctcgagaataagaaaaaatctagatatcaggactaaagtctaagactacctagaagagtgaaattatgctgagccccacactgatggtttggagataattcatctccagtgtttaaggtagggacctgggaactgggccaaagcatgggtgaaaggtgagaatgaagcgggtctgactgtggggcaaggagaggacagtggctgattatgggacagggaagatgtttaccacctctgagtggaagtttatcaccaccgagaaagtggatgaccattatttggtgaactacttatactgctgtattttgtgtatagtactaaatatatatatatatttgtttcaggattatttaatggttttgcccatgtggaaagaggcatatgcttattctatttctcaatgacatttatgagtgctataattataataacaatgatgaaagtttgactaatcaatatgtaaatagtacttatagtgagccaaatctattagaaagccagccagtctaaaagagaataaagttcccatattgcaaatacaaattatgatagtttggaataaaaatcaaattatattttgctctgtgatgcattgtgcatgctatctatgttctttgcgtctccttccatctgtcttcccgctgtttccctgctcattaacacctctactagaaagtgggcagggtgatgacaagaaataaaaatacaagttgaactgcaactaagaatttaacatttaaaaaatgccaacgtaagaatgatataaatatctcaattgtgaaaatagactgcgaccctggttagtatatggtattttaaatatgtgaaaaatgtgaggaattggagcacatcccataaaaaagaacaagttcacagaatgttatcaagggaaaggactgcagagatagactgcaggagcatctttccatacaggtgggaaatgcagaaaaattcattaaaaaaaaaaaaacgaattagcaagtacgcgtaaactctgaagacctaaacacatttctggaagctaactgcaaagcttggcctaaacatggaaatgctgaggtcacttgctggagtcaggtacggcatctgcaatggaaagatttttttttttttaaagaaggttatttcaacattttcaaaaaggaggctggggtggaaatatatgacactaggtaaatatacatcaaaatatttatatcataataggcatgtagtttatttaggctacttttattatgtttatactttacatctcaagatttctacaatgaacatgtatcaattttattatgggaaagtgggctttaaataaaaaatttatgttctgctctcatttgcttatctgtcagtggagtttcttcagtgaattttactagtcaacccgtttttacaatgggattgagacagggatcaatgctgggaatttctgacatgcaaatgattttaatgatgaaagcatggagtttagtcccaatgaggtcatgtatgcatgctgattagatttatcagactgcttctaagcaggaaggacttttaaaatttaaagattgagcgacccaacttataggaaattcagtggctcaaactatattttccaagtggtgtgataagataattagacacaattaacttgcagctagaagacaattaccaccacaaaatgttaattgtttgttctagaaattcctgcattcagtctcaaattagaagtatgtattaatatatataatattatacaaatatattattcattacatattacatgtaaaagctaattgagtattacacatattatttattagtgaatctccctgagcttcaaggaaattatagacttcaaaaaatttttgtggcctttggtacaaatgaagccgattttagaatttcacagattcttttatgaggataaataagtttttgtttatatttttgtggtacaaacctaataaagtgcccaaatcatcggcctaaacatggaacttatttcaagatgtattgattgatttaataacacaaagttgctgaagtttttaagatatattatctgaaaccaactggaaatttctgattatatttccaaatctgggcaaactttggtgaaccctatgtctgtgaaaatgcacacttgcttatgaatctgataagctttattctgagatccactgtgagtaatgcaaaactgaattcagaattgaggatgtcctgagtttaccccagaattcaccaaaatattctaatttgttaaatacaaaaactctcattgaaatggatgaaaatgatcatgattagcattaaagccgtaagtgtagattaagtagctttctgtttaatgcttctaaatagaatgcttctaatggtacacccatgttattttctattaagatatattccactcatgtttatcaataaaagctatatgtatcacacacatactgatttctgaaaattgaagtttatacaagtaaagtaattttttcaaagttacagcatggctggctagaacctaggtatgcaaaatcatacataatcagtggtcattctacgaaacaatgctacttctccctgtcgttagagaactaggagggacctttgaaggaatttgataggaactgaaagtattgtcatgtataattataagaaagaaaggttaaagtgtttcccaaaataatttttactttataaatgattgattacaaaaagattagaagataagattaattaggtttgtatgcctcttttacaatttattacttgtcattgtacaagttttaaaatttctgccttttgcttttcatttttaaaatggggataataactgtgcctgtatcacatggttgtattggtgactatgatttaataatataaaaggcttggacaatgcaatatatcagtgtagcaaaatttcatttataccccatgattatatacaaataaaaaagagaaaaataacaataataaaattaaaataaaataaaaaatagctttgcagtgaaaaataataatataaaaagcttgggacagtgtttgacacatcataagtgttcaaaaaacattagatgttattatcactatatgtcaagcactatgttttgcccttagtatacataattttaatcattccttacaacagcagtgggaggataaatattatcattcccacatggcagttttcgtaagtgaccatttttgcatggctaatatgattaaaagtcaacattcatacccagatctgtgtaagtctagaacagcaagttggtaaattaaaaactattttacattttcaaagagttgttaaaaaaatgggacagagaccatctgtagcctgcaatgcctgtaatacttactgtctgaacctttagagaacatgtttgctgactgccactctagtgcagttttttcttctgtaatatcagactaggctgcctcctgaaaaccagatgcctattttaattgataaaatcattcatgttttcatttatttgacagatatttattgagtacttgatatttgtgaggcgtgtgtcaaagtttgttcaggctgctctaacaagataccttagactaggtaatttacaaacaacggaaatttattgctcacagttctggagcccagtaagtctaagatcaaggcagcagcagatttggtgtcgggagagggttcattctctacttcatagatggtatcttcttgctgcaccctaacatagtaaaggacaaacaaacttctttgtcctctttcataaaggtactagccccatgaccgaatcacctcccaaaggccccacctcttaaaactattgccttgggaattaggtttcaacatacaattttttttgttgttgggttgggggatacaaaatttagatcatcacggcattttctagacctgtgggtaccaggtctaggaaaatgagtgagataataacatttccatcaagaaagttgcaatcctgtgaggaagtctaagagaaaatagacaatcatgggacagggtgaaaggtattttggttcaatatcacaggcttctgtggaaacacataggagggactttgaatgtagcattaaggagtcagatataccttcctggtggaactgatacttgaaataagtccgaatttttagtttaagagtaggtatagagtattctaaattactggagaagcaaataagtacaatgcaaaaagaagtatgagaatctgaaacgtagttgaagtttatggtaatggtggaacttaggaggagggtccctgttaaaagagagggtgagaaagaaagagtgcaaagtataaatatcatgcatgtcgtgctactgtttaaaatttatcctgaaggctatgaacattgtcacactgtgggattattggaaactttcagcagggaagtgacacactaaaatttacattttcgaatgatccttctggaagcatgggagatgaagaacaaggattcaagagtgaggacagggcttgcagccatggagttaaagggcctggatttaccctcatgtcttgatcaactctaacattacatgaagaagacttctcctcagacattggacaataggcagcacaagaaggactgtgaatctcgggggaagagaagtaagtgaggtgagccctgcactgcaattgcctaggattttcgcctggaggcacattttagactgcagagcagagagggagattccaagcaaggaaaagttgtcttatataattgaggaggcagaacttgaagtttaggaagtctggtgtctgtaaatggtgaggcagagatctacagagtagggagctacacagaaaacgggcttgagaaatatacacagtgggtcccatgagtctgaaaaatatcaagacaatgcacagcgtgaaatgctacaaggctgggcaaagaacaactgtggagttatgagaggagcgtatttccacaatacacacagactgcggaatcatttgcattaccaccagatagcatggagagccctcattgagcctctttacttggagaatgcagtaaagactccatccagaaggactactctgcagtagtgggctaacccattcctagaggaaaggtttctctagccctgcccaagcacaacttaaaagcaagtctcaaaaccatctaactaaatacttatattagaaaagaagtagtatcaacaatcaatgatctaaatttattagagtctaaattcccaccacaagaggctggaaaagagaagaaaagttaaaccaaagtaagcagaaggaagagaataaaaatgataacaaaaatagaaaacccaagacaaactgagaaaatttatgaaaccccaagctgggtttttgacaacatcagtaatattggtaaatatctagcaaaactgatacaggaaaaaaagggaagacaaaaaattatcagtcaagaattaaagaggggacatcattaactatcctatagattttacccagataataagggaatattagtaacaaatttataatgacaaagttggattgttgggaaaagcatcctgtggtagcagtaagtagccatccaacaaaagccactataacaataacaaaaacacatcattcattaaccaattttatgtggcaggtcctggttaaagacagtggaaagaaaccaaaaccaactaaagaagaaaagcaaggattatttattcagtgtttgctatagcaaggggagtctgccactgtcacttgtgttttgggagagaatcaaaggcaagcagaggagtgggaagcttcatagtgagaaataaagggaaggcttcaatcataccctgactggaggctgttgtcttggggaagttggaggtaggctaaccagaagcagaacatcctctgtgattgcttaggggtgcatatttggctttctctggtttgtcctaagtttggagtggggacagatattgggaaagctgtcagttatgaatcaagtcctggccattttgagccgattgttacagaagtttttgcttagcttcctatattgtttctacagatagcagcctgacttatagcaggctggcttcctggactatttattgaagttaacagattggctttctggacaagattctggaggttgatggtcaaagttctatttttatacatggattagttcatgtcagtttgtatattcagtccctcagtaataaatgatatagtgatacccaattcattctgaaagcataatgaaaagagtgacccagtcttcctgggagcatccgagaagcctttacagtgaagctaatatttgaagttgccttaaattctgaggcaaaaagaagatgagaagaaattgctaccagagatgaccacattaaaaaaaataataagcaggtgggtgggtggtgtgtttgaagattagtgaccttttaaagaagcttgaacataggcgggtggaggcagacagccaggaaagaaaggtggaaccaaaatgtaatggactttgagtgttgttctaagatgtaatcttatgggctccaagggagacaggatgctttaaagccaatagttataatattagacttgtattttaggaacatgatccttttgatagtggaaaatatgcatggggtgggtcaggaaactggaaacttgcacacaagctaggatggtattttaccaattggaggaagtggtgggaaaggccttgatttgggcagggacggtggggatacagcaaagggcagatagaacaaccagggcaacattttggacatgcagtgcgtgctccgtaaatatctgttatatttttaagtgaataaatgggacatttaggaagtggaatgggttaggtttggtgactgattggatattataaggacaggaaatagtcaagaactactaaagtttttagcttcagtgactgattgtatagcaatgctatcagccaaagtgtgaaaaataggggtgtggcagtttatgagtgaggatgccaagtttcatttggggcatgtctttagggcttataaaattggaatcagggtttgggggggtcactgatggcacataggtaatagctggaattatgcaaagaggtgggattggtcagaaagactttccaaagctaggggagagggtccagtccttgaatgcactgattctcactttttaaaattatttatttattttttttgagccagagtctcaccctgttgcccaggctggagtgtagtggtatgatttcggctcactgcaacctctgcctcccaggttcaagcaattctcatgcctcagcctcctgagtagatgggactatgggcacatgcccaactaatttttgtatttttagtagagatggggtttggccctgttggacaggttggtctcgaattcctgacctcaagtgatccacatgcctcagcctctcaaagtgctaggtttacaggcatgagccaccatgccagcctgcactgatttttaaacagtggataaaagaggaagaaacagtgtttgccattaaatactgttgtgtgctacttctttggaatttttcctttagtttcttgcacacagtttaaccattcatctacttgtatgtagggagatgaaacagaataccttttaaggaaaactatggaaatcacattgggtggaatgtacagaattcggagactctgactctttgagtcctgagctttgcgtgagggtgaatgacctgttgcacaaagggacctgagttaaaatccaagctcacctaatttctgtgaccttggccacattacttttctcagttatacactgaggttaatgatatctattttaaagagtttttaggattaaatgagataattctacataatatatgtaaagtgcccactggtgtcttgcatgtagtttgtgctcaataaatataagttgttattatttttgaagacctagaagaatgacactcaagaaaagccatcaatgcaatttttttaaataaaataaaattatggtattatttttgttgtttatattgcaaagttgatcatgtgaatttcacatttctctcttttaattctcccctacctaagaaaaaacaaaatcaattttttttctagagagggattttgaaaaagtttcaaaatagcattttcaaaatagcattttattatttctttggttcaacacgtgtttatccttatctaaaattaccctgaagattatttcctaatatggaataaatgcttctaggttacaagcatttattgggtgccttaccatgcatcagttactgtgctcaatgccagaatacaaagatgagtcaggagacttctcttgagaaattcattcattcatttactcaattaattatttatgtaactccttctaaagggcaagtgcttatctcagtggtaaaggtagagcagggatagaataaatgcacaaaaagactcggagctttggcagactgtattaaagtgaagggagacatgagagaaaataataaacaggtaaatcgagaaggtaagtttagatgttgcttagtggaaaaaaagtgaaaagaaataataggtagagattgattggaagagaacagcatgtgtggccagatggcctctggggattggggtaggattggggaggaggatgagagaaatgagtcaaaataattattataaaacaaaaatattgcataattgggagcaaaggaaattatagacatcacgcacacaaaaaaaaacagcccaaggaggaaaaagctataaatgcttaaaatatattaatttggaatcacattttaatcattttagaggttttatatgctcatgactcccactttaacctcattcttgaactaatgataatacttaaggtagggggaaaaaaagatctctttctctgttctcccaaatactcactttgggtaaacatcctgattgcaaattaacctcagtcatgttggatagaatttttgttataagtaagatttttgtgttggtcattctcccaaccaagtagatcttcattatctgtatccttgaagttctagctacggtctttaaattatccaaccagcatgtagaatcaaagtgatactgaaagtcataagactttgaaactagaaaggaccattttgtctaattcatccttaattcgcagcaggtggaatggaggctcagaaataaataacagagagtgaaaaacagtaattggcagagcaagaacagaaaccctggtttcatatcaccagattcattgattgagatctttccagtcttcccatctattcaagaaactagcacttcctaaatgccaggcactgtaaagctctgggttcctggatgagtaataagtttctctgcaagaaaacactctctcattccctagaacattgtagagtactaaaagatgtctcaattaagcaaatgataattcataacctctcaaagtacaatagacattattgaaaatgtctaattgtcacttgagagcaaatcttcgacatgcttattctttacccttttgcatcaagagttttaaaaatgatatttcaatggagaaggctttggaatgatagatttggagcttaatctagactgagacttaccaccttttgacctaggaaaagttgttgagcttcactttctagtggcaaaatgtgaccaaagttaccagcccaatgccagggactcatagaacttggtgtgttgatggaactgtccttcagttgcactgcttgaggttaggaggctgcaggaggttgggctgagaaggcccttgggcccacagtcttcaaaccccagtacacccagctcttctctacttccccaaagctctcagggccctttgcaaacaagaactcatgcaggacagtgaactctgccctacatccaagggagaaacctgaacttgggagttggaggttgcaatgaacactacatcaccggccactcctactcagcctctgtgattagttcttctcatctctgatctctgaatgctgtcatgttccagggctcaatctctgtagtgcttttcttttctgtctacattaccctttgtcatatcatccagccttctgattttaaatgccatctatacataattctgatgtatatattaactctagagttggaagtctcaactcatatttgactacctcctcttggttgtctaatagtcaattcaaaattagtaaatccagatcgagctcctgatttccctcaccaaacttcctcctgggtggtctttcccaactcactaacatggcaactccacttgttttttcagttgctaaggtcaaaaactgtattcttgatttctttttcttacatccaacattcaacctatcaggaatcttgttggttctatcttcaaaatatgttgaaacctatcttttaaccactttcaccactaagagtctggttcagcccccatcatctcctgcccagatgacgcaagagcagcggtctcagtttcagtgctcagtccctctgtttctgtattttccctcttactgtctactttcaaaagcggccagagtgatcagagtgaaatggaaatcagatgttcctcttctgcccaaagttctctactggttttctatctcactcagtgaaagccagagttcttagaatgatcccaaatgattaacagggtctgtcccataacaattctttatttttctctgctgttattctcctacccaatctctctacttcagccacactggtcacttaatttttttttttttaacattcatggaaacttctgtctcagggcttttgcacttgctgctgcttttgcctgaaatgattttccctcagaggtttgccaagctcttcttccccaccttctgagtgaggaatttcctgactatcctatctgaaattgcaaagctccctccaaccccagtaccctccaattctctttgtaactttatttttctctctatattatctgcctatgtatctatgtatctatctatctacctatcatctatctatttttctatttatctgttgtttatatttccccaataaaatatgagcaatgtttttttcctttgttttccgttttatccatttctatatccctagtgcctagagctaagtcctgatgggtgggaggtgttttgtaagtatttgtgtgataaataagtggtgttatccttaatagttgtacaatatttttttataaaaaggcattttgggccaggcgtggtggctcatgcctgtaatctcagcactttgggaggccgagatgggcggatcacgaggtcaggagatcgagaccatcctggctaacacagtgaaaccccgtctttactaaaaatacaaaaaaaaattgggcgcacgcctgtagtcccagctactcaagaggctgaggcaggagaatggcatgaacctgggaggcagagtttgcagtgagccgcaatcgcgccactgcactccagcctgggcaacagagtgagactccgtctcaaaatataaaaataaaaaaataaaaataaaaagacgttttgcttcatttttagtttatctgtttttaaataaattctaattctttagataatagtgggctttagggtcaaggataaagtgggaggatatatcaaaaccacctgcaacacaccaaaaacagaaaaaatcatagacagtgaattttgcaaatgttaaaaataaaccattctactcaaaaaggagagagagagagaagagggagagagacagagagagagagagagagagagagaaattcccaggggctagaacagagaaagtccatcagagttggggttaaagtgtcatgcccaatggcaaagaggaccaaattaggaaaaaagggactgaggtttcagtgcctgttcaggaggtggagttaagggtgtgttggccaaggtggaggaccacagtggagccaccagtggaaggctggaggtgggcaggggtgaggtgttgagttagttccaatcgatgtagaggaagaataacccatgaagggctggagcctggcccatatcacttgcatggggccccaaattgcacaattcaggtggagcagtagccttcaggttctaatttcagggtgggtttagagccctgaaacccagagaaccagactgtgcacatcaaactcatgatggtcttgcctctaggaagggtggggaagggaggtggcaaagaggactttacctacagtgtttattgaaaggaacaatacagatgtgaagaaattgttatcaattttcaattattgtgaaaatgtggattttttctgccattctaagtacttttctgtaattattttaatatcacaattattttcaaaagaaaaaaattaaagaaatagggtagtcttttaaaactaagagtatctagtctttctgtgatatttctagtgacttaggtccacttcccatatactttaactggtagtatcaggagtgattttaaaaaagagcaaatgtctattaatatatgtttttcctattttgtttgaatgataatatatgacaatctgttaaaaagtactttcttgggttaaaagtaaaaaaatgaaatctgattttttccttttgttaccttgatcaattgtgatagcactgacttagatagaatgcaaaccataggacaactcatacaattcccatcctatggcattttatagtgaaggagaattaaagtcaaaagaggcagtcaagtatctttggatatttatacgtaattgtcaagtagactttatattaagtgcatagttgtatgtgttagtgtattgctttattatttatttatttattaaattccatttttattttagatttagggggtacacgtgcaggtttgttacaagggtattttgcataatgctgaggtttgggcttctatagatcctgtcacccagatagtgaacataggatccaatagaaagtttttcagcccttgccccactctctccctccctccttttggagtccacaatggtgtctatggttcccttgcttatgtctctgtgaccccaaggtttagctcccatttataagtgagaacatgcaatgtttggttttctgtttctgcattagtttgcttaggataacagcttccagctgcatccatgctgctacaaaggacacaattttgttctttaaattaaaatttaaaacattttttaaaagaaataatccaagatgttttcttgcttagtgaaaactgctcaggtgtacatctggaatatttatttgctgtaagacttcctggaaattgctactggatataataatgtactattgatatggtttggatgtcccttccaaatctcatgttgagatgtaatcctccttggtgggtggacaggcagggggcctggtgggaggtgtttgggtcttgagagtgcatccctcatgccttggtgctgtcctcaccatagtgagtgtgttctcatgagatctggttgtttaaaagtgtgtggcttctctccccaccaccttgctcctgctttcaccatgtgaagtgcttgctcccactttcccttccaccatgaatgaaaacttcctgaggcctccccagaagcagatgctggcatcatcttaggaaggatgcagcctgcagaaccatgagccattaaacttattttcttatccagtctcaagcatttctctacaacaatgcagaacagcctaatacaactattaatccatattcatgtctataccaacagcaatactttgctgatagcaaacgggtatgtatgctaacactcctgaaaaaaaaacaccttccattttcctcaaggccaatttggaataagagaggcattgttattctgcatcattgcatcatacatcatgctttcagatatgggatttcgctcttgaaatttcaccttttaaaagaaaattctctgcttttcaaaaataaaggtattttctttggagaaataatctccactcaaaatgtaatttaaaaaaaaacatgcttttgaatcacactcttgcatccccttttcactttttgttttggctcactgcagatttgaaagctgctaaacagatcttactcaaattttccaaaacaattctttattggaaaaagattaggaatcagaaacgtaaaattatgagcccaagaatgctcttctaaattttaagaatttgatgaatctagatatttaaaataaaactccttctcttgtatacacttacttaatttttccattgtaattactcggcatttcatgtagatgcacatatagtcaaatttttatatgatctgcttggttcttacatccaatcttggcaactgtggcctgggatgaaagccaaatctgttcctaacagagtgattatccattcttccattacttattccatttagagtatgtggatatgttaatgtctgcagaacattttaagatgttcagagtaaaagagctttattaattccagatttgtgaccaaagatggggatcttttaaatggaaatggcaattgggaaatccaggacataaaagtagaaggggcattttaaccaaggagggatgagaaaggttatgagaaatagaaatagagagatgaaaatataaaaagagatctggatctaacacaatcccaggagtaacattccaggagttctaacaacaactgataatgtcttaacattgatattctcatcaatcgtaactgtgcttggaagtcatacgagacactaataatatagtactcgtgatgggcttaggttatatgccattctcttggaatttcaaagggttagaatagctttcatgaagtgagagtgaagcatgtatgcttgtcttcagaccatcacaactgagaaaaataattatattaataaaagggcttaattagaaaggagccatttgagaagaattaagtcactttgattaatataattacctttctcacagaattaatcaagatttaactttaacatataaccccagatcacttgctagaattctgtgtgtctgaaaaccaagttttgaaactcacttttcatgtagattcattatcctggtgttcccaaacttagtttatcagctggaacaactgtggagctttggccaccaccccagaccactaactcagaatccctaagatggagactgggaatttaggttgcttgcttaaccctctacatcagaggtctttaacctttttggcaccggggcccgtttgatggaaggcaatttttccacaatggggcagggagagggggatggtttcaaggtgaaacttcctgattctcagattcctgaatcctcagattatcaggcatgatttagattctcataagaagcatgcaacctagatccctcgcatgcacagttcacaatagagtttgcactcctatgggagtctaatgccactgctgatataacaggaggcagagctcaggcggtaatgaacgctcacctgccgctcacctcctactgtattgcccagttcctaacgggccacggactggcacaggtccacagccctggggttggggacctctgctctaggtgtttgggcccttgcatgatggggatgagtttcaaatatcaaaacattcagcactttgagtaacttgttaatctttggtatataacataacaataaaatctatcatttattgttgtatactatgtgccagaggataacgtgcattttctccatccacaccttaatgcttccaggcatcattattcccatttgacagatcagaagttaaatagcagagcaagtctctggtttgcctaaggttttacagttagtaaaaggcagagccaggattccggcacaattcagcctaactctggagcttgtgagcttctcagagtagcatccataggatgttatgatccttcatacaatggcctgcccatgtatatgaggtttggtgttggcatatttaataagaagagttttatatttatttccacaaagtcccaataattttcagctggtaagaattctgagttgtgagatggtaacagaattctaagcctggttgtctcacaatcctttagctgataaatgctttgagatttgcattttaattataacaaggacaaaaatatggaaaatacaaaatatattttctctcttcatatggaagggagaagaaatgtcttctcccttaggagctttgtagtaaatgaaatgtcccattcttaagcttttctctctttgccttcttcttactccccttcccacgctaggtttcagttcattcccaacagtgcaggtggctgtaggaggtacaacttggctgaggaggagaaagcccattggtaatgttctcatgttcttctgtagatagagtaagccttttccacatctaaagggctttgaaattggcaggaggattggaacctcaatcctcattcctaagtaatacttctaggtttccagcaactcatttaatttttgattcctgtgatccattcttatataaggttatctgcaaatttgatgtaatctgcattgtacttcaacaaaccacaagtcaagggtttcttactgtgagtttcctatagaaagataatgctgtgaataaaaatcctacaagaaataaaaaatcatggcaggctccgtagaagcagtgaaatatatccatcttttaaatataaacatcctaaaatgttaacgcagaaagagtaatagaaaatacgtgaatattgaaatgaaccaattacgcttgctaataaaggtagtcttgccagtttgcatcaagcttttggttctcaggaccagcctgcatgtgtgttaagagttgctttgtttatatttttatctctctgctacacgctacgcatcaagtaaacatggacaatgccttgaattagaggaatgaacatgtttttcgggcaacctggcaaccgtgctgagggagtgtatttcacattcactttctccactctcctgaagttgtcaggctaagtgcctaccagctgggtgtttacactttggggctaaggaggggaaaatgttttggcttatacacactgacaccaatggctcaaatcccagtaatttgagggacccctgttgttccgcaaattcctgcccattttctagttcacttaaaacatgctgacaattgtcttgtatgttctatcagaaaggaggactctgtcattgaagcaaaaaaccattctgtgcacaagcagagtgtgtgtgattaactcacatctttcatacaaatatgtatatataattatgtttaaatatttatggaataatgatcacatttctatgtgagagaggaacaaaaatagcaattagattgcagcttggctgtggggcatgtgtaataaagcttatcctacccttcacccctgcctccaggctatcagagcaaacttttttgttcaaactattgtatcatataaaattttaataatattttgaaagaataaagggctgtcccttctgtggcattattccacatcctgacctcatctttggtaggatttcttctttagagatatgtactctggcatcatttgaattacggagcagaacaattctactaaaatgcccaagaatacaataataaaatgtagaaattttaacttcttagagacagatgcaaatattcacttctccatgctcacagatgaaattagtaaataaatgaagagcattgatttttattttgttccttttaaagaaacttaacaactgcacaggaatgtaaagatgtatgaagatgtaattatagcacaagccagcatatgataaatactacaacaatggtacaagaacagtcataggagattacagattagggggcctctgtttctagcaacaggatagatgagatcgtctaaaaactttccacacaatacattagaaaagctggatacaattatgacaaacatctttttaaatgcacagttaataatttgtgaaaataatgtaaatttctaaatagagagaatgagaaggggatcttgaaaccaaaaagatgaccccacaccatgcataaaactgtcctgggaaaataagtcactcttagcaaactagagtcttggatttgaaatgggtgcccatgtgaccaagagccaaagcctttggcatgtgcaaagtgaagaagtatatccctgtataaagctagaattcttcaaaagctacacattagactggtgcaaaagtaatggcaaaaaccacaattgcttttgcaccaacctaatatttagccagtgaaatggtgaattaccaaaacaaacccccaaataaaaaatatagattaggaacacggaagacaagaaaatgtatttctcttcacagggggtctggatgagtgaaaatctccttcaaaaattgataactgcaggactgtccttgtagggcaatttggaaacctgaagtggagaaataggcttgctaagaccttgcaggatttagagataaagcccagaaaaacatgagttagcaataaaaaagcaagcttactctgaggaataagcaaccttgagcttgtttgctcaagcacaatttgactacaaggacttcagatactggacttattatatccaaaatttaaatatatttcaaatatataaatatgtgatgcagagatttaataacattagcaaggaaaagagtactatagatcgagtatccctcacttaaaatgcttaagaccagagtgttttggattttggattgttttcaatactgaatatttgcatatacttaatgaggtatcttgggtatggaagccaagtctaaacaaaaaattcattttagaaaattgttttatttttattgatttttttttagagacagagtctcagtctcacccaggctggagtgccacgtggcgtgatcataactcactgcagcctcaaatttctgggctcaagtaatcatcctgcttcggcctcctgagtatctgagactacaggcatgcactgccatgcctagataattaaaaaaaatttttttttgtaaaaacaggatcttgctatgttgcccaagctggtctcaaattcctgggctcaagctaacctcctacctcggtctcccaaagtactgggattataggcatcagccactgtgccctgcccatttatgttttatatataccttatacacatagtctgaagatagttttgtgtgatgtttttaataattttctgcctgaaacaaagtttaaatacttaggaatggaattttccgcttgtggcattatgttggcactcaacaagttttagattttgaagcattgtgaattttagatttttagattagggatgctcaaccagaataaaaaagactgatatatagatgtgtaagaatcaaatagatcttctagaaattaaaacaaaaatgtcgaaatgaattttccattgggtgggataaacagaaaagatacagctaaagagagaattaatgaagtataatataaatttaaatatatttcccaatatgcataggagagagacactaaaacataagaaccaaaaaaagagattaaaggacataaataataaaggatatggtgtaataaatgtctcagtagttcaaaaaataggcctttagaaaaggcagtgaagattttgattttcaattcgggaagcagaacaaatcccaataagacaaactaaaagaaatgcacacaagacacaccacattgaaatattatggtaatatatgcagactatcacagacacaagtcagattacgaacagtgagaaagattatctgcaaaagaatggcaattaggccaagagctgacttctcaataacgataatggaagccaaaagtggtccaataatactttccaaatctagagaggaaaattgtcaaactagatttttatacctagaaaaccaactttcaagatcgaaggagaaattgagacattttcaagtaaatccaaactgaaagtttatcactaatgataccttataacagatatttctctgaaagaggaaaagtaattccagaggaaaagtctgagatgcaagaatagggaacaaagaaatctctaagtttgtaggcacagctaaacaaacatgttataatatgcacaatcttggaaggttaaaaaatataagacagcatggtaggcagaataatgaacccccaaggatgtccatgtcctaattctcagaatctgcgaatgttgttatatgacaaagggaaatttatttacttatttttctctaagcagtccctcctttttcatttgcttaattaatttttttaaaatgttaataactttaggggtgcaagtggtgtttggttatatggatgaattgtatagtggtgaagttgggcttttagtgtacctatcacctgagtagtacacattgtacccaataggtcatttttcatccctgagcccatcccactctccctccgagtctccagtgtccatgataccactctgtatgcctttacatactcatagcttaactcccacttatagaagtgagagcatgcagtatttagttttctgtttctgagttaattcacttaattcgttcttttttatggctgaggagtattttatggcacatacaccatatttctttatccactcatctattgatgggcacttaggttgattttctatctttgcaattgtgaattgtgctggaattaacatgtgcactcaggtgtcttttttatataatggcttcttttcctttgggttgatacccagtggtggatttgctggatcaaatggtagatctacttttagttctttaaaaaatcttcatattgtttttcatagaagttgacctaattgaaattcccaccaggaatgtataagcattccctgacaaaggggaatttacattgcagatggaattaaggttgctgatcagctgactttaaaataaggagattattgtggattatctcctgggcccagtaagatccaaaagggtctcagaagtggaaaagagagacataaaacagagtcagttagagagagatgtgactacaggtgaagtcaaagtcaatgcaatgtgagaagtactcgaccagcaggatgaaatagaaataataaaataaggtagtataaatcattccaaaaaatcagtagtaatgataaaataaaaatatattcaactcactagttaaaaaatatagattgtcaaattgagtaaaaacatcaaaatctagctgttgctttttataagtgacatacctaaagtgtaagaacatggaaagactaatggcaaagttatagaaaaattatgcttagaaaatactaacaaagcatgtggctggtatagctagattaaaagcagatcaaacatttaaaagtaaaaatattagtagtatcaaagaggattactacataatgataagaaagtataatctaaagaaatatacaatcatttcaaactttcacatgtcttaataacatgcagtactttgaaaattcccaaagcaaatcttgacaaatttcaaagagcaattcataagtcaactgttgtacttgaaagtattaatacttcttaatgaatggcagttcaagcagaaaaattaataagtaacttgaacaatatagttaacaagcttgagataatagacctacagagaagctaaactcaaaatcacaaaacacatattattctcaattacacgttaaacatttataaagtgttaccatttatattcataaataggttgcaatagacaaaaaattatatagactcaattaccttatcaactcaaattagtaatcaataacaagaatataacttaaatgaatctattcagaaattaaagttaaaaatttataattaatttatgagttaaaaaaatcataatggaacttaggaaacagaaccgtatgcttttttagacacaatattgaaatttgtgaggcagagctagagtattaaatacttgcattaggaaagaagaaaagtgaatactaatgagataaacatacaaattaagaatttttcttaaagaacagaaaaataaaacctcagggaaagttgaaagaattaataaatgtaagaagagaaactcatttagtatgtaacaaaggagagaaacacaaagtcaaagctgttttatagagaaagctgataaaatagataaagctatagtaaatttgagcaaaagaaataaaggaaaggtacaaataaactattaagaataaaatatgcagcataactacaaaaacagaacaaatttactctttcagaattaatactaaaaacaactttgtggcaatatattttaaaaatgagaaaaaaaatcctagaaaagtatagcttacagaattgattcaagaagaaatagaagacctaaatggaactataatgaatatggcaactgacagtagttacagggcagagattattggatgcttaccaatgctatttcctcttcccggaagtacatctgccttgccattagattgaagctacaagtttggtactagtcagtggaatgagggcgaaaaagataattataggactatcctccaaaatctttctttcttaaaatctttggcttgctttcatttgcagctgaaggtaaagaaatttcatgtggtggattcctacaaaagaaaaagctgcaaaagagtcaaccaggaaaggtgctagacacacatccaatggctgctgagtgatgaatgagaaagaaaccttcggtgtagtaagccattgaaatttgggggaaatttgtaatagctgttgctgtaaacctccgcactgcaaaacacacacatcctagataattaaaagacaacttctaccagatgttgaagggcacatcattccaatcttatgtaaattattccagagaatagacaaagaggaactattcctccaacagattttaggaagccaaaataaccttaataccaacactagtggaaaacagagtaagaaaggcacaacatgatttatatgaggaaatcctaaacaaagtattagcaaattgaatccaacgaaaaatatacttgaattgtgtgcacacatacgaaatcattcttcaattaacaaatatttttaagcatctgacgtatgccaagcagcaacataacaccttgagacgtcagagatctttgcccttgtaaacctacattccagcagaagaaaatagagaatctataaataatagagacttcctagtgtcatccttgactgaggcaatctttttcttggtgctgcctaaaaacgcctttgttttttaaaaattgtatattattgatgactcatactagcttatagttaaaaggaattccccaacctttagaaaagtatataaatcattataaggaccagtttacttattatgatgtatgttgagtgttcaaaacagcaaaaaagagtaaaataataaataccacatccacccacagcttataaaagaaaactctgcccattctcctgtatatttctctgtgctgtttctttcttgccacatagggttaccactaacctacattgttttccatttttattgcacgcttatatgtatttttaagcaatagaagctattgtttacaggttttagaactttattaaatacgtttatggacagtaactaattccatttgtttaaacggtttggcataaaatagtaaataattcacagctagtaaaaccaaaaaacaaagagataacaactatttgctgcttacaaggaacaaataaaataaaaaactttaaatatttaattgaaatcacaaccatcctgatataataaacatactagctgtaagacagagtggtcatgctggacagcatcttcaagaaaccctccctgtggtttttatttgatccccataacatctattttaaatcttcttaatggctttcaataacaacttataattatatttgtaaagatcaggctcacttttttaacagattgctaagtctcatataattcattagggcaaattatattgtttccaacagttcatttttctgttgttgctggtgatttctattgatgtaatgaatttctataccgatttatatccagctatcttccaaaactctcttgtattaattctaataattattttgtagattatcttgggtttttctaaagatataattacattttctgcaaaaactaatagtcatgtttctttataatttttataaattttacttcctagtctattcttattggatgaccattacttctatttaaatgttgagcagaagcagtgcaagaaggcattcttttttttttttttttttttttgagacggagtctccctgtgtagctcaggctggagctcaggctggagggcagtggcgtcgcgatctcggctcactgcaagctccgcctcccgggttcacgccattctcctccctcagcctcctgagtagctgggactacaggcgcccgccaccacgcccagctaatgcttttttgtatttttagtagagacggggtttcaccgtgttagccaggatggtctcgatctcctgacctcgtgatccacccaccttggcctcccaaagtgctgggattacaggtgtgagccaccgcgcccggccaaggaggcattcttgtgttattccagattttaaaaagaacactgctaatagttcagttttaagtacatttgttacaaattttatcaggttaagaaattccctttattatattaccaataattgttctcatacaagttatttttatttccgctgattttacagatttggaaagtgaggcgtacacaggctaaataacttgcttaatgaaacactggtcacagagtcagaatgtgaagaacaggttgtaggactgcaaagctcttgctgggactgtggtcgtaggcttgctctccgctttgggccccactacgtgattaaaaatgaaggcttaggatatgtttacttggcaaatatcaacaggaagcagttggagcaatataaatttcagacaaagtaaaatgaagccaacagcattaaaatgagacaaagagggtcattttatgttatcaaaagttatggctcagaatggtataaattatgaattgtagcatatcatcaagctatcagacaaatacatggaaattaagagaaacaaaactctgtaggagattttaacatttctacctcaccctttaacagaattaaaataataaagaataaataatgacacaaattatttgaataccataattaatacattaatgttatatatcattttctcttggacatctcaagtattaacaccattaacaccccaaatacaatctcaataaattccccaaatcaaaaattatacatatatttctttccataaagcaataaatctagaagttaataaatttttaaacaaaatagtttgtctaagaaattttttaaaaatcactcttttaaagaactattgtgtctgggtgcagtggctcaggcctataatcccagcactttggggggccgaggtgggcggatcacttgaggccaggagttcgagaccagcctggccaacatggtgaaaccctgtctttaataaaaatacaaaacttagccaggcatagtggcggacagctgtaatcccagctactcgagaggctgaggcaggagaatcatttgaacccgagaggcagaggttgaagtgagctgagatcacaccactgcattccagcttgagcaacaagagtgaaactccatctcaaaaacaaaaaacaaaaaacaaaaaaactattgtttcaaaaatgaaataaaaactatagttggtctttcaaaaaacaatatgtttcagaacactaaaatttatagactatagatacattgtaatttaaaaaatttacaagcattagtgattttgtcattaagcaataaagaattaatatttcatgaactaaactttatattcaaaaagtttaaagaatcagcaaagctaaagagataagaaagataaagaaaagaagaacaataaattatggagaaaagcaatagagtgtatagggttaaaaactggttgtttgactctcaataaacttggtagtgatggaatgtatctcaaaataataagagctatttatgacaaacccacagacaatatactgaatgggcaaaagctggaagtattccgtttgaaaaccggcacaatacaaggataccctctctcacctctcctattcagtatagaattggaagttctggccagggcaatcaggcaagagaaagaaataaagggtatttaaataggaagagaggaagtcaatttgtctgtgtttatagatggcatgattgtatatttagaaaaccccatcatctcagagcaaaatttccttaagctgataagcaatttcagcaaagtctcaggatagaaaatcaatgtgcaaaaatcacaagcattcctgtacaccaataatagacaaacagaaagccaaatcatgagtgaatgcccattcacaattgctacagatacctgggaatccaacttacaagggatgtgaaggacctcttaatggagaactacaaactactgttcaaggaaataagagaggacacaaacaaatggaaaaacattccatgttcatggataggaagaatcaatatcatgaaaatggccatactgcccaaagtaatttatagattcaatgctatccccatcaagctaccattgactttcttcacagaattagaaaaaaactactttaaattccatatggaaccaaaaaggagcccatatagccaagacaatcctaagcaaaaagaacaaagctggaggcatcatgctacctgacttcaaactacactacaaagctacagtaaccaaaacagcgtggtaccaaaacagatatatagaccaatggaacagaacagaagcctcagaaataacaccaaacatctacaaccatctaatctttgacaaatctgacaaaaacaagcaatggggaaaggattccctatttaataaaaggtgttgggaatactggctaatggctagccagtacttcttccttgcactttatacaaaaattaactcaagatggattaaagacttaaacataagacctaaagccataaaaactctagaagaaaatctatgcaataccattcaggacataggcatgggcaaagacttcatgactaaaacaccaaaagcaatggcaacaaaagccaaaattgacaaatgggatctaattaaagtaaagggcttctgcacagcaaaagaaactatcatcagagtgaacaggcaacctacagaatgggagaaaatttttgcaatctatccacctgacagagggctaatatccagaatctatgaagaatttaaacaaatttacaagaaaaaacaactccatcaaaaagtgggtgaaggatatgaacagacacttctcaaaagaagacatttatgtggccaataaacatatgaaaaaaaactcatcaacactggtcattagagaaatgcaaatcaaaaccacaatgagataccatctcatgccagttagaatggcgatcattaaaaagtcaggaaacaacagatactggagaggacgtggagaaaaaggaatgcttttacactgttgatgggagtgtaaattagttcaaccattgtggaagacagtgtggtgattcctcaaggatctagaaccagaaataccatttgacccagcaatcccattactgggtatatacccaaatgattataaatcattctactgtaaagacatatgcacatgtatgtttattgcagcaccactcacaatagtaaagacttggaaccaacccaatgcccatcaatgatggactggataaagaaaatgtggcacatgtacaccctggaatacaatgtagccataaaaaaggatgagttcctgtcctttgcagggacatgaatgaaactggaaaccatcattctcagcaaactaacacaggaacagaaaaccaaacacagcatattctcactcataagtgggagttgaacaatgagaacacatggacacagggagtggaacatcacacaccggggcctgtcggtggggtggggagctagggaaggaattgcattaggagaaatacctaatgtagatgacgggttgatgggtgcagcaaaccaccatggcacgtgtatacctatgtaacaaacctgcacattctgcacatatatcccaatacttaaagtataacttaaaaaactggttatttgagaaaaacatgaaatagacaaatatctataaattataataaaaggaaatacaaatttacaaaatgagaattgaaaaggcaaaaagaggcacaaagtagaaatacaaaacaccaatgaaaagtggaaaatatgctcactagtaagcaaaatatagacactaaagtactgttcttcactattaatataagaaattctggctgggcatggtggcccaagcctgtcatcccagcactttaggaggctaaggtgggcagatcacgaggtcaggaggtcaagaccagcctgaacaacgtggtgaaaccccgcctctattaaaaattacaaaaattagccgggtgtggtggtgggtgcctgtaatcccagctactcaggaggctaatgcaggagaattgcttgaacctgggaggcagaggttgcagtgagtggagatcacaccatcgcactccagcctgggtgacagagcaagtctccatctcgaaaaaaaaaagaagtgtttataataatactgaattcaagatcatagtaacgtgtctgttttttacatggcagctagaagttggcacatcatttcccaaaaggtagcttttaaaaagtcacacattttgactcaatatgaatctaacccaaataaaaaattaaaatatcccaagacttttgcacaagatccaattttaattttttatttataaatgaaaattaggaataaatcattatgtacaataatagaataattgaaaattaaatgagataaaaccacatgatagaatttttagaatatgactgatgcaggaaaatgcttactaaatagtttttagtgaaggaaaaagtaggacacacctgctttttacagtatgtacagtagactcatggcatttaacattgtaacctttgattacttaacattgggtggtttgtgatggacctctgtgatctatggtgaataatatgttttcatttggagagagagcatataaaagattacagatcatttcctagtcaatgtttatatatatgtctcatacataacaacttatttgttttataaagctctataaaggcattcctaaattctttgatatgagaatactcaacagatatgagtatttgacatattttgtttttcctacagaacatcatcatccaaatccccttttcccctccctgactccaaatatttattagaacctgcagcataggagtgggtgtgctgggctggatacagaacattaggctgacagattttgactgtcagttaatgtaggagatttctgatttgatctcacaatgtcccagcaccaagttagtgaggatgtggctgcttggggttcgggtaagcgagtgtcctggtagagcatactgttttaaagctcagcaactgtagaatgaaagaatgctccgaagctaagacctcttgactcattatgactaatacatctcagagctgtatcgtaaggcaaatcagttctttataaataattaacttgggtcaacctgaggtcagagataatttgaatgctacatgactaaatgtttcctaccatctagctagtcttgctgactccttgccaaaagctgtgggagcccacctcttgtatcagcgtgatctggatgtgagacatggagtcaaaggtgatcatgttggaaatgtaaggtttaatgactgccctgttggatctaggacttgcatggggcctgtcacccctttgttttggccagtttctcccatttggaaagggtgtatttacccaatgcctgcacccccattgtgtctaggaagtaactaacttgcttttgattttacaggttcataggcagaaaggacttgccttgtctcagatgagactttggacttggacttttgggttaatgctggaatgagctaagattgtgggggactgttggaagggcatgattgtgttttgaaatgtgaggacaagagatttgggaggggccaagtggggaatgacatagtttggctctgtgtccccacccaaatctcaccttgaattttaataatccccatgtgtcaagggcaggagcaggtggaggtaattaaatcatggaggtggtttccactatgctggtctcatgataatgagtgagtctcacaagatctgatggttttataaaggacagtttgcctgcacaagctctcttgtctacagccatgtaagacatgactttactcctccttcaccttctgccatgattgtgaggcctctccaaccatgtggaactgtgagtccatgaaatccccttttctttataaatttcccagtctcaggtatttcttcatagcagtatgaaaatggactaatacgcttctcttcccacttcaggcctcacttgaatgccatttcttccaaagagcctcctttgaccccccaagagaaattgtattcccttcttatgttcaagagttttcagtttcatcactggcatctcttatacatcttcattcggacttaaatgctcatagagtgaagaaaggatggacgtattgtgtttacttaatggttcccagttagttccatcttgggaatttgaagctgggagtagatatttgatctcttgattctgcttgtttgtaagagtctacagtgttagttttctggaaggcaaccctattgtttggggcaacaaaccactaggaaacattaggactgaaagaccaggtgaacttgagattactattgctgagtaggatcatagggtacactttagtattttgcttgtgcttttcttattatcaatttaatacaagttcatttaaaaatgtagaaagaatatacaatgtaaagaggaagaaaatacctcatataccttgtatccagaagcaaccaggtcatctcttagcattttcatttcctttccagctggtataaaagattttcagtactgagagagctcttagaattcctctcaggctcactctaagtcaggactctcatcttcctgtctgttatcctttctattacttcataataccttattttaaaaaattaaggaaattacaggttggaaaagataaaccaggctggaaatatggagagtatgaaaagtggtaaagaaaaacaaaccctttaacatctattttctcagcatcacagagagttgaacttgtatagagtttgaactcccctcaattagaacctatagataaataattacaaaattcaaaatccaaacataccacagcaaatcaaagcaaactaaatcactccaacagcctgccctcccacccaccaaagtgacctataagaattatctaccaaatttatactatatcttgattattaagtccttaagttaaaattactgcagacaaatttagttactttactttcctacatttacacaatatttcatgagcttataacaaacactttgattaaaactcaatggtcaatatgttagcgattttggacaaggtaattttaaaagatgtaggataatttaaagtgattatggtaaataaacatggattatacaaaaatttatttccacagcagtagtaattatagaataaaaaattagaaatagcaaaaatatttcacaataaaagcttggttaaattcctacatttcaataaaacatgatgtcattgactgttggatagtgatatggtttggctgtgtccccacccaaatctcatcttgagttcccatgtgttgtgggagggacctggtcggaggaaattgaatcacgggggcaagtcttcccgtgctgttctagtaatagtaaataaatcttgcaagatctgatggttttaaaaagaggagtttccatgcgcaagctttcttttttgcctgctgccatccgtgtgagatgtgacttgcttctccttgccttctaccctgatcatgaggcctacccagccatgtggaactctagtcagttaaacctctttcttttgtaaattgcccagtcactagtacgtctttatcagcagtgtgaaaacaggctaatacagtacattggtaccagtagatggggtgctgctgaaaagatacccaaaaatatggaagggactttaaaactgagtaacaggcagagtttggaacagtttggggggctcagaagaagatgggaaaatgtgggaaagtttggaactccctggaaacttgttgaatggcttagacagaaatgctgatagcgatatggacaataacgtccaggctgaggtggccccagatggagatgaggaacttgttgggaactggagcaaaagtgactcttgttatgttttagcaaagagactggtggcattttgcccctgccctagagatttgtggaaatttgaacttgagacagatgatttagggtatctggtagaagaaatttctaagcagcaaagcagtcaagaggtgacttgggtgctgttaaaggcattcagttttataagggaagcagagcataaaagcatgaaaaatttgcagtctgacaatgtgacagagaagaaaatcccattttttgaggagaacttcaagctggctgcagaaatgtgcttaagtaatgaggacctgaatgtaaatccccaaaacaatgaggaaaatatctccagggcatgtcagaggtcttcacagcagcccctcccattacaggcctgaaggcctaggagggaaaagtggttctgtgggctgggcccagtgttcccatgttgtgtgcagcctaggaacttggtgccctgcttccttgccattccagccatgcctgaaaggggccaatgtagagctcaggccacaacttcagaggtgcaagccccaagccttggcagcttccatgtgatgttgagcctgtgagtgcatagaagtcaagaactgaggtttgggaatctccacctagatttcagatgtatgaaatgcctggatgtccaggcagaagtttgctgcaggggcagggccctcatggagaacttctgctagggcagtgtggaagggaaatgtttggttggaggccccacccagaatccctactggggcactgcctagtggagctgtgacacaagggccaccatcctccagaccccagaatggtagattcactgacagcttgcaccatgcacctagaaaagctgcagatactcaaccccagcccatgaaagcagccaggagggaggctgtaccctgcaaagccacaggactagagctgcccaagataggaacccacctcttacgtcagtgtgacctggatgtgagacatgaagtcaaaggagctcattctggaactttaatatttgactgccctgctggattttggactttcatggggcctgtaatcccttcgttttggcaaatttcttccatttgaaatggctgtatttacccaatgcctgtacccccattgtatctagaaagtaactaacttgcttttgattttaaagatcatagacagaagggtcttgctttgtctcagatgagactttggactgtggactttttagttaatgctgaaatgagttaagacttgggggactgttgggaaggcatgattggtttttgaaatgtgaggacatgagatttgggaggggccaggggtggaatgataaggtttggctttgtcttcactgaaatctcatcttgagttcccacatgttttgggagggaccaggtgggaggtaattgaatcataggggcaggtctttcctgttctattctcatgatagtgaatatgtctcacaagatctgatggttttaaatccctgcacaagtttttttttttttgcctgctgccatccatgtaagatgtgacttgcttctccttgccttctgccatgattgtgaagcctcccaagccacatgaaactgtaagtccattaaacctcttttgtaactttcccagtctcaggtatgtctttatcagcagcatgaaaacaagactaatacagatatcatgggactatgatcacaatatttgaactaaaaagctattgtcaaatactataagcaatattattctatttgtggaaaaatatattaacacttggaaaagagactgaaagaatattgatcaaaatctaaagcaggtttatttgtgggttatgagatctggtgacttaatatttttatttgtgctttttaatatttcccaaattttctacaatgagtatagattgttcagtagattgttctgaacataaataagacagattatctgtgtgaaaaatattagaatatttatggagaacaatctacataaacagattgtagattgtagaattattaacctagagtatttgggctcctcgaatgcccataaatgggtgtcaaagagtctgtgtaccctgtggaataatttgtatgtgtttgtatatattgttgctgatggaaggggatccacatctttcacaaaattctcaaagtgctctgtgatcctcaagacctaagcaaaagtactttgcagcaacctgttctaaatcttgtttatgacaatttaaagtcggtgtctctaggctcctcatttcaaagattgtgcatatataaactgttttggctcatgggccattcacagtgaaagcatttgggttaaagccagaatatttatgggagtaaataaaattagtatccacttgaaatgacagcagaaaaggtaagttattttttgtttgataagaactgtatcttactaccaaaactctctaatacatcctgaattattcaaaattaagactcaaattttcacattaaagttgactagtgtaatgatgtgtttctgttaaaaatcctcattatgaaatacattttgaaacattacctactgaataaacattcaactttgctttcttttgatccctacttaaatcaccatataacactgacgtcttactctgtaagtcttcacatggtctttgatcaaaagcagcgtaacctgaaaatgacctttataaatggacttacattttcctcttgtgaatggagatagagaggggctgaaagctgctctgtgcttctttgcctaacaagcctaaaaatcttatgggaaaaatgtcaacatcacccagacatttgaaaccctgaagggcattggtttgtcatttattcaaaaattaagttttctttcattttgcctttacactttcattttggataattgtgcacataaacttacacacacttctttcattcattaactgaagaattgcactctggttacaaagaccacatcataagtacttactaagttataagttaaaaagaagtggattcatttttaatttattattcaataaaattcttatttcccatttgggacagatgcagaatttgtggttcttttaaaatagcagcctgcaggcttatttctatccagagaacagtacagtccttttgagtttgaccctataaaatgttttgcttatttactttttaatttcagggttgatcgttgcagtcattacacacactggttcatggtgaacattggaagcttgcctccatattctctgaccaaagaagccacgtagtggttctcccttttaaaaaagttctttacaatcagctgcagccagtttttgattttggagaactttatctagaactgtgacattttgtggagttttatacattggaatgtcctgttcactaacccattgataggagaggggtgcgacccccttgctgcaactcactcactgcttctcatttggtgattgatcaagttctaccatatagactactgaagttttcattatgaactgtcaactcttaaggataaagagcattgttccaaaagacatctttttaagaactaggaagagtgggaagaatattagcctcctccaagtcaataataaggattcttattagaggattctgatgaggccacttacacatgtatagaaagacagggccaggtgtggtggcttacgcctgtaatcccagcactttgggaggccgaggcaggcagattacttgaggtcaggagttcaaggccagcctagtcaacatggtgaaatcccatctctactaaaaatacaaaaagtagccgggcatggtggcaggcacctataatcccagttaccagggaggctgaggcaggaaaattgctggaacccaggagacggaggttgcagtgaagccaatgtactccagcctgggcaacaagaacaaaactccgtctcaaaaaacaaaaagaaagacaaaaatcaaggatctacaacatatggaagaagaaggggttccctgaagatacatctggtaatttcactatgttttgcaggccaagacttaatagtgaaaataattcaacttttcagcttaaaaacaaaaaacaaaaaaacaattttctcctaaacatgtaactattgaaaaatctaagatacagggaatcagaagcaatgtatgagagaaggcatatgtttggttaatgtgtttcattatatgttaaatgtagttccccactactgatgttcaatagataaaaaataagcaaaatgtgtgaaataaagtgctattatagaatagtgcaaaaactttccaatggtaggctcttgtctcttttctatagacttgtgatctgtggggatgtgctctcatgctcttcattaataccctgctccaccccatcgttaaatattccagacttttctaagtaaataccatccaacaacagaatacgcatctttcattgtcacagttagctgatatctatggaacgctccacatttctccataacttcaatactgaagcatgtgcctattcgtcattctttttgccaacccagtgacttcaacactactcttggttttcttggttttccttctctggcttacccctatgatcgttacaaaaaccacggtttccatctccattccaatttagccactatgtttatagccataatttaaatctaatcatcagtcaagattactttattgctaacatcctaaattctaacatttcctttttttcttccacaaagttttgttttactgctccattcattttcttaactttactaatcaaatagttatccttcttttctacttcagttccttattgctcctctgattttccaatccagtggcactcaagctttggcatacattagaatcacttgttgaaacacaagtgtagatcgtaccctccagagtttctgattctgtaggtctgagatggggcctgaggatctgcattttaacgggttccgagtgatactgatgctgctggtatgaaaaccacactgagaaaaataatctttgttcaataaaactcttgttccattagagaaataagtgattgggaagtggaacttacaagggtggttcaacatatacaactcaatcaatgggctacatcatatcaacagaatgaaaaacaaaaaccatatgatcatttcaattgatgctgaaaaagcattctctatctcgtctgttttttatatcatccatcttttaaattttggggaacctattgggtaaaaaataatatcttactctttaaactggtatagtatttttttctatcatgactcatgtggctaagcatgtttttcatatttgttgtttgtttgcctttcatttatgtgaattgactactgaactcatttctgtttatttctttctcagtgagtgataggaatttttatacattctggttgctaattcttcatttgttattatacaacacaattttattagtctttcacttgtgtttcaaccatgaataagtattttttatatattttaattattttaatataatcaaggttatctattttttttacactaccatttttgggtttttatcctagttagcagggccttccttatcctggggtcattaacgaatattagacctcttttcttttctttctttccttcttttctttttctttctttttctttctttctcttctttctttctctctctttctttctttttcctttcttccttcctttttccttcccttctttctccttcctttctctctctctttttctctcctctctttctctctttgtttcttctttcttcttttttctttgagacagagtctcactctgtcacccacgctggagtgcagtggtgcgatcttgggtcactgcaacttctacctcctgggttcaagctattctcatgcctcaacctcccaagtagctgggattacaggcatgcgccaccatgtctgtctaaactaaatcttttcctgatgcttttaaagatttaaaaattttttgctctactttttaaactttccgaaattattttttctgtatactatgatgtaaaaaatctaattttaattttgtccttattaatagtccatcttttatttatttccagtgctacccctctcatagaccaatacccattatatgtgagtttattctatttgattggacaatttacctaatatggcaccaatgctacactattactatagctttattaaatgttttgatatctggtagaacaagttctcccatttacttatttttcacaaatttctttttttttaaatgatagcaagtttattaagaaagcagaggaataaaagaataggcaaagcagccacaaatttcttatattctcttgtaacttacttctctgtgtaacttttagaatagacttgtaaagttccacgaaaaatcttgttgagacttttgtttgatattgtgttgaattcatgcattagtttagaggaaattcacatctttaaaagtgtggattttctcacctacacacatcttaacctctccacctattccagtgttcttttatgcccatcaggaatgctgtatcattgaatccacaaagatttaaccctcttgtcattgttaaatttattcctagatacttaagatttaactgaaaaagaaaacattcctttaacgtcaatcctctctcttgatctaatcctgacactctaatttcttaaactgtccattttttgaatgacctgtttggagagtctgttttctccattttcataccacctgctatattcccttgcaatatggctttctttcctgacactgtagaaaaagtattctttaaaatgttgctgatgatacctgaattgcctaattgcataattttttctcagttttaatcattctcaatttctctgcgttacttgtcgttattgatccctgcacctatgtcaatactcctccattgctgtccatggcatttcactgtcctgttttttttttttttcctattacactctcattgcttcttatctagctttttattctcccactctgtgaacatactgttgttgtgacctctttctatatgctttcttcccatgcatttgaggatgacagggatttctatatgctcccaacaatgattttcgtgcttggcaggttatgggtggtgaataaaggtttcttgaacaaacggatcaacctaatcatagctttcaaatgcttattaacaggaaagtcaggtcactattgattattgggcaaatttgaactctgtttaccatttctgaggctacattatggtctcattttactttcagtcgtatttttctcctccactgtaatcaaactgttaactgcttcataatattgcctttgttcctgaggttttctctacctgggattccttccacttttatttgttgaactcttgtccattacttaagaactatatcatctctctccttttcttggaagtcttttctcattcttcctggtttgatgtaatctcttccacttttgaatcttcagagacactgtctgatttctgctactctcattgcatttgtattcattaataataaaaactgtctttaaaattggcacagattaaaaagaacgataattcccaatcttggcaaggtgagggaagagaaagtttcaaaaattcttgataggaatttctagagcataatttggcaacatgtgtcaaagccttaaatatgcaattagtccatggtgcagcaatttccatttccatgaatttttcctaaggaaatagtcaaagatatgtgcaatattgctcattataacatgtttttgtaaaagtaaaaaaacctgtaaaaacctgtgtccaataatctagttttggctcagcaaaccttagcatatctataatagaagacaacaaaaccaaaatcattttataaaagaatatttatttacatgggaaaatgttcacaatatgaaaaataaaacaggacatacaacaatttttctagcataatgtcattatttcagaggaaaataaatgtgcttagaaaatattagaaagacatttaaaatgctattaatggttttgtgagattgtggttgatacgaatttttttaaagttctacttttctatcttttcaaaattttcatatgtgtgcattttgtttataatttatatccaaatggactacatgatatgttgcccaggttcctcctcctctcttctctaccctcatctattaagacgtaggctctcattcacctgctgctggaggactgaaggctgacctccccgtgttgagacccagttctccaatccagcaactgcccttcactgagcaaagctgccactggagagagttgcctcttccaaggtcacatgcccttcccacaggaagtctgcatctagtgactgtagttataggactctaaactcctatcccctttaccccaatttgagagaatgctacagggccatccagcttcagatttcactctgcaattagttgtgggctttcttaaaacttcttcacgacccaccttctccctctgtctgatcatggttctttccttccccctacagctgtcaatcctgagagcccaccctagtaaacttcctacatctgctttacagggaagctcacctggaacatctgtttgcttggcactttacacttattacctcccaaaaccttgcaataggattttagggcagttattggcgtctctgtttttcagaagaagaaaactacattcaaaatgtttatgtattttatgcaaaggtacactattaataaatgtcagagccaggtttgaaagtagctgtgtttggatataaaaactatgctttttccattaagccaaatggctctctgcagtcagttgtgtgctttattatttttgtgcttttctagttctctctggtagatggtaaattcgttggctgcagggattttatcttatttgtctttgaatcccctgcagggtattgcatagtaccttacacataataagtgctccatgtttttagaattgacttgaactagttgaggcttgaaatgtagttctacttctgttccacaaaaaaacagattccctagcaggaaaagaaaatcatgatggtaagatttagaaattgttttttgatttaaatttcatgaaataatctcctaaaaaagagtgatactaattttcttctctttgcttaatattagataacaaaatgcaattttccagaactttgcttataattactaaaataaacaaatcagtgagtgtaataaacttatactgaactgtgatggcaaatactatggtttttaccttatatccctgattcagggttctctgaaatctaagtcattggagaagagaatctactaagagtagaaaaatgtaacaaggaaataagcttgctccttacacaagaattgaaagtattctaagagtcttaaagtttttgtggcagcagagatgcgtgagctgacatttccagcaatcaatggaatttgcaagtgcgagatgaattttccttaattaaaatctaccagattaatcatattttaagtacaagtaaaatgaatgtataactaattagttatgctgttaggaataaatgacattaggttcatgtttacatttagggaggcagacatttgaaagtaaactacaaagactgctgctatggtctgaatatgggtgttctcacaaatttatgcattagaacttaattcccaacatgatagtattaagagatagggcctttgggaagcaattaagtcataaaggctttgctgtcgaatgggattagtgctcttatggacagttgaagggagttgcctcaccccttccactctgtgaagacacatagaagctgctattatgagcaacaagccctccccagacactgaatctgctggctccttgatcttggacttcccagactccagaactatgagatataatttctgttgttgataaattacctagtctgggatattttgctgtagcagcctcaacagaccaagacaaacacagagtagagaaactttccatattgactgagttttattgttcttgcactccagagaatcaacatgaaaggatatgtctaacaccaaataggggttaattagttgaagttattaaagccagaaggccctggcaaatggcataacatagctacagcatgcatggttggtaactgacccaaattatgctataaaaatggtcaatgctacagcctggatattctcctagtggataaaatatgaagccacctaggtgagatgattttaggtgccaccacactgagtgggtcaaacaccatgagtcctagaattctactgttagaaatttatcactttggttgaccactttagctcctattacaatatgtatttcccagagaagctaatactcatcagttccttaacacagatatgccttttattgaaaaaaaaaaaaaacctacagaaatagaggtctggaagcaagaaatatagtttcaaaaatcaaatgggacaggccataattataattgcatatggttatgatcaatgctgaaccttaagcctgagacctaaaatcaatctagctttcagtcaacttactttagtctgtctcatcatattatttccttttatattagcctgttctagaagttctgtaaacatttccttgaaaaggtaagcaaccatctctaaggctagaagatcaatctcattgattatatttttccctgaactctagttcttccttttcagcagaaatattactgtccttagtggctcaagcctgtaatcctagcactttgggaggctgaagtgggtggatcacctgaggtcaggagttcaagagcagcatggccaacatggcaaaaccctgtctctattaaaaatacaaaaattagccaggcgtggtgttgtgcacctgtaatcccagctgctcatgaggctgagtcaggagaaacgcttgaatccgggaggcagaggttaccgtgagctgagatcatgccactgcactccagcctaggcggcagagcgagacttcatctcaaagaaaaaaaaaaaaaaagaaatattactgtcctagaagaaaacctctttaactcttatttctttcccctctattataaagtgccaataaaaaaggcttccagagcatataggtatttatattaaaacaattaaaactactgtttatctattaactccatatattttcaaaagaccactattaggttacccgcattctgtccataggcccatcctgatagaggctttccttccagttctaaggtgagattaatgtcttcttgaaaatgcttagaaattttgaagtttctgttttcagttgaaatttctcaaattgataaaccttttcaactaataattatattagtttgttttcatgctgctgataaaggcatacctgagactgggaagaaatcagaggtttaatggacttacagttccatatggctggggaggcctcataatcatggtggaaggcaaggaggagcaagtcacatcttacgcggatggcggcaggcaaagagagaggttgtgtagggaaactcccatttttaaagccatcagatctcatgagactcattcactatcatgagaacagtgaaggaaagaccttcccccataattcaatcacctcccaccgggttccttccatgacatgtgggaattgtgggagttacaattcaaggtgagatttgggtggggacacagccaaaccatatcaataatcattccttttaaaattgcaaataccatcagtaaagtcaattgtaactctttgttataatttacatttacaaatatgttgtattaatattagaaattataagttatattaatatttataaatatgtttgtttacatttattctgttacagttgactactgatggtatttgcaattttaccatttgtaacatagagtcatttgtaaattaatacaaactattttaagcctttgatttcttttaattcctaccttagggcattcactgaaagaatgagattaacttgagggaaagggagaacacagagaatggggtggtaaaaagatattgctataaaagtctttgggtagcagaaaaagactagcattggggcataggaaaagacatggggtagtgacagacaagtgtttgtatcgaaattctgccttaggtggattttgattaggatgggagagagaaagagtgagaatgagaataagaatcacacacgcgtgcgcacacacacacacgcacacacacacgcagagcaagctctttgttacttcatttctgccttctttctatcttcacccaagacaagtgtcttttttgctatgcgaggacttaaactaggcttttttaaaccgaatttgagctatactctgggctaattgattcttgcaagctagtctggcatttatggtgcctgcttttgagaaaagatgcctttgcaaatctgaacaataagcacttaggaagcctcttacaacaaattgacttataaatcaggcacacagttacagatagcgttttaacaagagaaagcacctactaaagaagtcagctgcccatcagatgatgtgaaataaatgtttcttattgagcaagtagaaaagaatggtgagctcgttcattttacagtcagaccatccccatgtggcagggtgggccaactaaagagggaaatgtgagccgttaaatatttagtaattatttggtgtataaaaactctagccatggaaatagcttatccacttaaaattgtaagtatattttgtaggaattttaatgatgtgtatgcattttgggatcaaaagatacatatagaaaataaaatgaaacaataaacacattgttcaacacactcagaaaagctacttggcaccattttaaaaaaatatatgttacgttcattttgcctttggctccttcatcttgttcccttgtcaattacctgtccctctccaaatagcccttttctctttccctattcttagaaggctcttttccctaagataattcagcactctctttcctcactcctgtatctttctagggagtatggtgtacagggtgatgtttttctctgctcaagtcattaactttgttagaagagcaccagacagagtcagtaggattcttcccttctcagtattaactaagcacctgtcaaggttatgttttcaggcaaagtttatggttggtacacagagggttagaaccttaaccatgacattatggagcacatggaacctgaaacttctgaaggaaactttccacttcagcttttggcaagaaaaataagacggagagaagagagggaattagatcatgacacatgttactcagagaaaaaaaaaagcaggaggtagtttaagaaaatggggtgaaggaaagcctaagagacaaaattctggcatcactttcctacctaggaaagtgctctcttctttcttatatctggcttctaagctaattttttaattattcttactgcctctatgttcctcaatacttcatttttaatgaaacacatgtttaaggtcattttcattatttatttttctagggagttctttctccaacttcagaactctctctaatattcttgtggttattcagtcttctttgatttttaagggattgtcaaggttcctgaagcaatgtattttcttgttcagcacagttttcagctgtgctcaatatttggattattcaaaagagagtattttgttttccttctggcgtgattcaaagtatgtagagtagtcccctcttatctgcagagtatacgtgccaagactcctgtggatgcctgaaaccacagagagtacctcactctccatcgacactatgactttttgatctgataactgagacaactactaagtgactaaccggtgtgtggtgtacatggcgtggatccactggacaaagggaggaatcatgtcccaggcaggatgcagtgagatggcatgaggtttcattacacaactcagaatggcgtgcaatggaaaaacgtatgaactgtttatttctggaattttccatttactttttcagactctggttgactgaaggtaactaaaaccacagaaagtgaaagcgcagatggggagggggaactaatgtataactatactttaataacacaaaaattaatgatgtagtatatttgctaagcaaatctggcaacaagaaggaagatggaaaacctcagcatcctgaagagtagttatttatctcagaatgaaattaaattttcaagagggtgggaaattatattccaacgataggatgaagagcagaaggagggttaatgtatgctaatattttagggaatatgagatatatgaatttgggtaagcttttttgttttccctttatcgtaggagaaaataatgttgtgtatgcattgaaaaatgcccattgaaaccatattttacgtaagatgtatacaatgctgacaaagattagtttattaatttataatgagtagaactttcatggaattacaagataaaacactatttctggtaaaaaggcagaattaagtaaagtaaaaaaattatctttacattttataaatggtcttggaattcagaaacttggtatatgtaaagtaaaagaaaaacagaactgcatgttggaaagaaattctctaatataaactgtaaaataaggaagattgttttttaaaatcctggattaaattacattttgataaaatatttgactttttcaaatgatgctggtatctgcttccatctaaagacagcatatgcttcagcttgaaacacatctatttctgttattagattctccttttaccataattgttcttgtttaaatcaccatttacctaccttttcatcacgactttaaaaattcctgtattgattcaatattatgatatgagaccttttaaagaagtatcttttttatagaaaaaaaatctgcttatttggaaaatgtgtaaaatgatggaagaggatactagttagtcatcaaaacatatttcctcttcttaattagcacacagttatgccacatttccaagtctcccttgcagtaaggtgcagccatgtgactgagttctagccagtgaaatgtaagcagaagagatatatgttatttccaggcctggctcataaaatgcaccctacatgttctctttcctgcaactttcttccttcaactgattgtggtggaaacaacaatacaaactttggaagcctcattttgagggtgtcagaacattcatcagagatataaatatttttctgtaaggtatgaggtattatacatttttagagtcgttttatataagcttagcctagagttattaataaactacctcaagataaataccaaaatacaacaatatccaattttatataataaacaatctttctgttaaaacattctctttataaatataatacaattctgttgactttgacattacttaatttcattatacttttgcctcactattaaaaccagatatcattagacttctctgataatttgtaggttgtctttctaaaattaaaccaatggtcaaagtagaattgtttccattatactgatatgaagcaataatgtaggttaagagctcagtaagaaggccagatatactgatattgaaaagcttacaggacagtctccatagcaacctcgtgcatattattttattagtttcttacaaaaaacgtatacctgaaaagtactatggaaatggtgaccccaaatgtctgactttcccaaggccacagttagaatgtaactgaacccagttagaacttgatattcttttgaaagctatgctaggaggctggataagtccacaggagaattcataatatcctgtctaattgccatatctatgcttgatttgggtaagaaaattctggaagagaacccattgacaaaaggcgtacagaacctatcaattaacactttgttaaaacctttaccttcctacataaaatcgtagacttttaaacatgaggatacatagaggccatttatttcaacatgcttgacaaaataagagctcaaaatctatctctgataagatgtagtttttctagttgtctatcttgcacatgaatatttacctgtgctaaaaagatagtccattccacttttagacaacactaattgttagaaattttaccttatgttaattgaaatctacctccctgggactttaaatgctcaaaggcaatcagattttcctttactgtagcttttttttttgtatttttttaaattttattattattatactttaagttttagggtacatgtgcacaacgtgcaggtttgttacatatgtttactgtagttttactctgctgtgcttcaaatcctttctgaccacatttgttgtacccttttcaatttgaagatgaatctccttgggagagaagaaagaagcaaaatcaaaattgagtggctttactttctctctgtcattgaataacatcttcttcaagcaggagggctatttttttcttattatccttattcgcacatagctttttaaaaagtttgctgttcccagtactcttcaataggtcaaggagtctccaaatatttgtgcacggccattattttggtatcttaagaaaataaaatgactcctctttcatcttctttgagtgatagggttattctttcaatcgcagcaaccagcaatgcttaattgtttgtttgtttgttttttaagtcacactaaacttgaacatgacctgtaactcattttagtggcatcaaattactatctcatgacaagtagtgcaaatgcatttgtgtcctatgcttaccaggcactgtaattcagcccatgctgaatgagctttaggagaaattcatatcctgaccctggtactgtctaaaaactcagtgcctttggcattcatatttatatctcttgaggatgctgatcattaggcacatgtatattttatgacttattgtaattgttgcttcaaacttttcttcacgtgctagaagcttatatatgtagcatttttccctttaattaactagatctcaaattatgttctctttacaggtcgagaacgcattcatcacaatacaagacctgggcaccatttgtattaaacttgcacttagccgtatctgatttaatttccaattcttaataggtatattagcttatatatgaaacacaaggcatgcctaaaacacaaagcatggcatatatagctttgaattgccctgatcaaatagctaatgatctgacactaattctcatatttctttttaaccatggctattttgttttccatttaatatataggaaatgaaaatttgcatttgtatctcagtagatggtttaaaattgactttcatatacatcaaatcctccccaaaccctgtaatataagcagggttggtattgctgacttcaaatcctccccaaaccgtgtgatataagcagggttggtattgctgacttctgtgtttagaaagaaaccaaagcttaaaaactgaaagataaaataaatgaacgaggactctccatcaatcctgttgaaagattttctattattataatagtaattagcactgaaataacactattttcaaggaccattctaagtgctttacatatattaactcatttcttcacaacaatctatgatgtaggttctattattgttattcttattttacagatagagaaactggggcacaaagtcacactgctattaagaactgagttttgaaccaaactattctgtctctagagtccatagccttatttcccatattttcaccttggtaaacatttatcgagaacatgatctgtgcaaaatgctttgttatgtacactgagagctataacaactaacaacatgtttgaagggataaatatgactgtaactttaaaaactgaagctatcgtaaaaatattacagaagcttaaatgttttttcccattggtatgaggtgggaagaaagagccctagtggtcaatctaggaaaccatttgaaggagatatgatttgaagctctttgcaatctgagaagacctttgcagcgtgagaaggactgtgacaggtgggcacctgggcaagagcattgcaataggacagcctacgtagaggcccagggaatgagactgtgggagtgaaaggtgagatttctcatgtggttgaagttgagggtgtaggagtgaggcaggatttagtaacagataaattacgaacatagcctcgagccagattgtggagagccttgaacactaaactgagaagatttgaattccttctatatgcagtctggacccaggaaaggtttttaaggacacgagttacataatcagataaattttagaatggcatctctggcagcaaagtataggcttaattggagagggctggactagagaaaggagaaccagaattggataaagacacaattgtccaggcaagaaagaggcaatgagtgtctgaactaagctagtgaaaatatgagtcaggagccttttaccaaagagaaacttgctcagaaataggataaactagatttggaaactcatgggaaggagaaataggaggttacctcacattttatagtctgaacagtggagaagttgcccctgtagtcacaggagacaaatatatggtcagttttggggattttgtgaaaaagcccagcccatgataatctttcttcttgaattttaacactcagctttgcacagtttggtcctctgcttgtattatgtgtatctcagtgtgtgtgtgtgtgtgtgtgtgtgtgtgtgtgtgtatgtatatatatgttatatatgtgtaatatatatgttatatatgtataatatatatgttatatattatctggcatgtatatatacacacacacatacatctcatatcagatcatctctcataatgtcagtgtgtattgtagctttgactgcctggttaacacgtgaatctactcatcgctgtatcggaaatctctctgatagcccaaatcatctcttactattttcataggtcatgctatttttcctaaaacacaagttaatctttctctcttcttgaatatttaaatattgatataaatttgaatacaattggtaggtaagatcaagggttgggtgattttgatggatgataacaatctagtgaaagtatttttagacatacgagttatgatttttttgcataattcttgcggaagaccgtgtgatagttttctgtgtgtcataaattatttcaaaccctttgcagtttcagtatgaaatatttctaatgaacaactcctttgaattatactagcaacattctatgtggctatttcagaggataatatgtctacatttttgctgtatgtttttgtactcttaaccacatttaaaccattgttaaccttggaacatcctaagatctggccctgtattttttacatcttttaaagaggtgacacaccctttataatgtgcatttttcactttttaaacctaccatttactttttaagacattttgaacgtttatttcatcctattgtgatttttaatttttctccattatcgcttacaatgtttatatataatttatgataataatgtatatttgcaatgcatataattcacctttttgccaattgatcttcattaagtcagtcaacaagagaagcttaataatgttcatgtcctttaagatgctatttaccttcatggttcagtctataaaaattgggtccaagacaaaggaacacactccagattagtcagacaatcctagcaattgttttgtcaattctattattattcatatgttgcttacttttattgagtctttctctaccctttcctttctgagccctaaaataatacttgctgccccattgacttcaggcttggcaacacagctcgtttggccaatgaaatgtaagtagacataacatgttgctctttaagcagatctttgagttattgtctgatttcctccaacttttttgtcctatctttctgtaggctagcacatcacagatagaggctgcgacttcagccttgatctcaaaataaagtgcacctggagcagaacctcagtcaatatgtacccatacaatgtagtgaaatataaacctttgtttttgtgagttactgagacttggaacttatttgttaattgcactacatttagcttaaactaatgcaaataactttctgcatattttattcttgtttggtgtagatcattgtagacattttccctacatattttctgaaaaatttagtatatttttattaaatggtatagtattataaaataattgttgtaaactttaaaaagtctttattctggttaacagtgtattgtgagcattaaaccagatgactaaatgtatacttgcctctttaatgatttaatagtgttctgtttatggaaagtggcatagtgtagtggttaagagtacagtctctgggacataaatttctgggttcaagtcactgttctaccacttactagctgtgtgaccataagatactaaatttatttgtgaccttaagtaagagacttatttatcctatgaaatagtaatccaatcccttattttgttaaataaatgactttttctattataaaaatatggtaaataatatcatgggtgccaccctctccctcatcctcacttctggcttacctcaatttctcatgagcctttattattattacttttaaataactttcataactttttaatgattgccattctaactggagtgagatggtatctcattgtggttttgatttgcatttctctaatgaccagtgatgatgagctttttttcatatgtttgttggccacataaatggaaggggaacatcacaaacccagggcctgtcggtgggtcgggggaagggggagggagagcattaggacaaataccaaatgcatacggtgcttaaaatctagatgacgggttgataggtgcagcaaaccaccacagcacatgtatacctaacctgcacgttcagcacatgcatcccagaacttaaagtaaaattttaaaaaatgtatatatataaaataccttttatattcctctttatatctagtactaccacaactactttaataaaaaatattaatactttgatctcttacctgaagtgttagtctacttttatcactcttatcatactttaatctgctctccatactgtagccagaatgacttttccaaatcgtaaacctcatcattcattcatcttcttaaaactctccaatggtttccattttctcttagaataaaggaaaaatttcttaccaagtcttaattattttcttagtctggtctctgcccctccaccttcatattttccatattccatcatgctgtctgtgctccatttctgaaaaattacaaaaaagaaaaaaaatcaaattatatatattagattaatcaggactccatagaaaaacataagcaatagtatatagagtcatgcattacttaatgatggggatatgttctgagaaaggcattgttagatggtgtccttgtttgaagatcatagagagcgcttacacaaacctagatggtatagcctactacacgcctagactatatggtatagcctattgcttctaaactataaacctgtacaacatgttactttaccaaaccctgtgggcaattgtaacacaatgctaaatagttgtatatctcaatgcagaaaaggcatagtaaaaatacaatcttataatcttatgggaccactgtcctatatgcagtctgctgctgacctaaatgtcattatgtgatgcatgactgtgtatgtgtgtatgtctgtctctgtgtgtgtgtctgtcaaaagagatttattataagaaattagaaattggctcatgcaattatgaagggtgagaagtctcaggatctgcagctggtaagctggagacccaggagaggcagtgctatagttctagtctgagtccaaaggcctgagaaccaagaaaattgatgttgtaagttccagtccaagagcaagagaagattgatgtcccagcctgatcagtgaggcagagagggcaaattttctcttaccttgccttatgttctattcaggccttcaatggattggttgaggcccacccacattgagaagggccatctgttttacttagtctacggattaaaatatatgtcttaaccagtgcttgcttcggcagcacatatacaaatatatatcttgtccagaaacaccttcacagacatgcccagaataatgcttttcatttgtttttgtttcttattatttttaatttttgcaggtacatagtaagtgtatatatttatagagcatatggaatattttgataccagcatagaatgcataataatcacatcgggtaaatggggtatccatcacctcaagcatttatcctttctttgtgttgtagacaatccaataatagttatttttaaatgtgttatttaaaaattattattgactgtagtcaccctgttgtgctatcaaatactagagcttattcattctatctaattatatttttgtacccattaaccatccccactccacccaccactctcagcctctgataaccatcattctgttctctatctccatgagtttaattgttttatttttcagctcccacaaataagtgaaaacgtgtgatgtttgtcattctgtgcctggcttatttcacttaacataatgacctccagttccatccatattgttgcaaatgacaggatttcattcttttttgtggctgagcagcactcccttgagtatatgtaccacattttcttatccattcatctgttgatggacatttaggttgcttccctatcttatgaatagtgctactgttatggatagtgctacaatctatgtgggagtgcagatatctcttcgataaactgatttcctttcttttgggtatttacccagccgcaggattgctgaatcatatggcagttttattttagtttttttgaggaacctccatacttttttccatagtggctgcactcatgtacattcccaccaacagcatctaaatgttcccttttctccacatcctcatcagcatttgttattgcctgactttgaaataaaagccattttaaaactggcatgaaatgacatctcattgtagttttgatcgcatttctctgatgatcagtgattttgagcaccttttaatgtacctgtttgccatttgtatgtcttcttttgagaattgtctattcagatctttagcccattttaaatcagattattaaactttttcctatagagttgcttgagctccttatatattttggtgattactcccttgtcagatggaaagtttgcagatattttctctcattctgtgggttgtctcttcactttgttgtttgttacatttgctgtgcagaagctttttaacttgatgtgatctcatttgtccattttttgctgtggttgcctatgcttgtggtgtattactcaagaaatctttgcccagaataatgttctggagatattcccctacattttcttgtaggaatttcatagtttgaagtctcagatttaagtctttaatccattttgatttgatttttgtatatggtgagagataggggtctagtttaattcttttgcctatggatatccagttttcccagcaccatttattaaagagaatgttctttcaccagtgtatgttcttggcatctgtgtcaaaattgggttcactgaaggtatatgaatttatttctgggttgtctattctgttccattggtctatgtgtctgactttatgccagtacaatactgttttgcttactatagctctgtagtataattggaaatcgagtaatgtgattcctccagttttgttctttttgcttacatccagaataatgtttataaaatatctgggcaccaccagacacactaaaattaatgatcacagtatactaaatttggaatataataatttatattaggtctttgtcattatagaaaaaatttactgaaatgaacaattttggaggaagtataaattaccaaataaaagcaagaagaaataggaaacaaaaatctaacaatgtccatgaagaaaaattttttaatatttcaaataattacttcaaaaactagtcctaggatttaccagtgatttatttcatgtttaagaaactgaaaatttatttgccatttgtttttagaatattaaaaattacagaaagttatataatgtgtcttataaaaccaacataaatctgaggccaaaatctgacatagagagcaaaagaggacattccaatacctgtgaggataatcagaattttctctctctctctctctctttctgtgtgtgtgtgtgtgtgtgtgtgtgtgtgtatgcctagtttgaaaaagttttttcattcaggagattcctctatatatttattatcacaattaatgtgttcctgccttgtgaacagtggtttagaaatataaatatatattcaaaacctcaaaatactaataaataagatttaaaagtattttcaggcttccacttctttctaagagtgactaataagcactggatttactgtccaacctgaaacaattgaaaaaacagaaaaaaaaaaaaaaaagaaacaatggctttcaagacactggacatcagccagtgaagaccagtgttttagtttggtagggctgctatgtcaaaataccacaaaattggtggcttaagtaacaaaaatgtgttatctcccatttctggagactagaaatccaagatcaggttgtcggcaaggttgcttcctctgaggactgtgagaaagactctgccccatgcctctcacctagcctctggtgctttgctggcaatctttggtgctcactgatttctaggagcatcactctgatctctgctttcatcttcatatgatgttctctgtatgcgtctgtctccaaatgtctcttttttttttttaaagaacatccatcatattggattagaagcccaagctacgctagcatgaccttgttttaactgaactaattagtactgcaacaatcctatttctaaataaggtcacattgtgaactataggggttagaactgcaacaaaagaatgttaggggacacaattcaacccataattgatagtgatccctgtggattgagacattaactaaagaagtcctatgatggctccaagttacttcctgaagagaatttccttctcacagagcagaaagagaaaacctaagtgaaggtcagtgatctccctgacttgagacaaagctggaagtccacgtgggccaaggtggctagagtggtcaggacagagtcttagaaaggagacagtagcagaaagaggaaactccagagcttcctctgagttttcagctgagcgccgatcaaggtatgggtgtgaggaaagtaccccaggccacagaaagaaccattctgaatgactgaaggaaacagttcttgaagatctcacagggtcaggaattgttcctcttcccatcagccagaggagaaagccttcatacatggagcactggttaaagtacctagaagtgtttttccttagtgatggggaaagattagccttaaactaaacactgctgtgaccccacctaacaatgctttaaagcagaacctaaatggctcaaacattttataagtaacttctttaaatctcagaacaaagctcaagaatatttatagaaatacagaaacatatagcacccaaagaggcaaaattgaccagatctagcatccaataaaaaaaattaccatgcatgcaaaaaagcaggagaatccaacccacaattaggagaaaaatcaattgataccaacccagaatgacactgatgataaaattagtagacaaagacattaaaacaattattataactaaattccatatattccaaaaataacaggaagatttcacatgttatacagacatgtgaaaaacctaaggatctaaattgaacttctacagtgaaaaactacaatgactaattattaaaaataacatttatgggattaatggcaaattagactttgcagaaaataagataagcagacataaatcatagaaactataaaaaatgaagcatggagagtaacaaactaaaaatatatttgaagaaataatggtccaaacttttcaattttgacaaaactattaatattctaaaagaaaacataggagatttcttaattaggacacaaaaaatgtagtccatacaagaaaaaagaaatagattggactttctaaaaattaaaaacttatgttatttgaaaggaactattaggagaatgaaaagaaaagccactgactgggagaaaatatttgcaaatcacatattggataaaggaattgtatcaagaatatataaacaccaaactgggaaaaaggtccttgcaaaccaaaaatctgataaacagttaatatctaaaatttataaagaactcttacaacctcaatagcagaaaaacaaataactcgatttaaaagtgggcaaaggacctgactagacatttctccaaagaatacataaaaatggcccgcgagtaaatgaaaaagtgtgcaacatcactaatcatgaaggaaatgcaaattaaaaccactgtgagatatcaccctgtatccttaaggatagctattatcaaaaggtcaaaagataaatgttggtgtgggtgtggagaaaaaggaaccctagtacactgataggaggaatgtagattggtacagccattatgggaaacggtatggaggttcttaaagaaatttaaaatagagcgaccatatgacccagaaatccctctctgagtatacacgaaggagatgaaatcactacctcataaagacatctgcactcccatgttcattgcagcattattcacaatagctgagatatggaaacaatctaaatggccatcaatggatgaatggataaagacaatgtgaggcatatttaccacaacatgaacggacctgggggatgttaagctaagtgaagtaagccaaacacagaaaggaaaatattgcatgatctcacttatatgtggaattaaacgaaaacagagagctcaaatacacagagatagaagatgaaacagtggctaccatggtgggcagaggagagaggaaatgggaagattataggtcaaagggtacaaaatagcagacacgtaggataaagaagtcgagatctaacgtataacataaggactaaagttaacaaaattgtattgtattaaagatttttgttaagcaagtatattttagcagctcttgtcacaaaaaagtatgtgagatggtagatatgttgacagcaaatctacatatagacaccattagctttcctagcacaaataaaaacagaactatatgatgatctcagtatatgttaaaaagcatgaaacatttaataaaagtcaaaagctattctttaatttaaaaaactcttagaaattagtaaaaagaaaaaaagaaacattaacatcagaaagactatcagacaacatattccctgctagtgaaacactaaccatctttcattaaaataagtaggacaaagatgccatcatttacaccagtactggagctaaaaggcgtccctcttggaaagatagataaatagactctgctgtttggaataccctgagttatgaataaaatggtcttcagaagctgctcagaatgccttcctgaactattccattttattcttcgtgctatcaactaagcataatgcttcctttgactatgagttgtgagtcattttccattcatgctctaaatctttggaactaataatgattttctatacatcagtaagtacacattgatttgcttctcttccccagatggggaggttgtattgagttggtccatgtaacaggagtcccatgtccctgggacagagacagaaatgcctctcggtctcctgaggctgtagttgttcggattaaaggaggaaagaaggaagtatcaggctgaatcctggctaaggatggaatcctgggaagcatgactgagtgttctttacatctgggaaggcctggagttgttctttcaactaggaagagccaggtgaaagagataagagggatgatcactaaaggaatgttgtttgctcagatggaatctaatccaaggccaattatttgagcaaaacagttccaaattcactcagaaagcttcctgttataacacgtttacattcatctcaggtatgctcagggttcataagttcattgcttatccatattaaaatattgcagggagtgtgagtgaccaccagaaaagttaactaaaggaatatatcagctactctgatggacaatttgaaaacaagaagaaaaatatgcactattaatcaatgttttcagaagtatctaatttagtctggcagcagaacaagggaattcaaaagaaaaatggaattttgttggagggggtcaaagtagaaatgtttcttaagtgttacagtgtgaaaacagagaaatgttaaacttgatgctgtcatacaaataactttgacctcaaaaagccagaaactttgaagaaatcttgatgagtcctacagattctatcatcacctacatatagatctcgatgccaaatctcaaggcagggtacccagcagagagcttctgggacatgtgtccactggggctgcagcaaagtttgtgttacataacactgctggggagattaagcacacagcgaggagggtagcagaactgtagtcactgctgtgaatactctccattaatcaatcgatcaacccacaggtagatcccgagcacctcacctgtgtacaggaaccagacttgcacaagttcgccaaagtgtttcacagaaaaacctaaaaccagctttggcttatgagtttggacagcaaagggcgagaaaaagaaaattgttgggaagaggcagagttaccaatagaaataattaccccagcctctaacagaaaaataacccttatatgcaacttgtgtaggaagtatttaggattcaatattgtaaatagaaatcaccatgtaaattcaaatgcaaagaaaaatattaatttattttattatacaatcgggtcattctacatgtgcaagacacaacgcagttttatactctgtataatttttttttttgagatggagtctcgctgtgtcacccaggctggagtgcagtggtgcaatcttggctcactgcaagctccgcctcccaggttcacgccattctcctgcctcagcctcctgagtagctgggaccacaggcgcctgccaccacgcctggctaattttttgtattttagtagagatggggtttcaccgtattaaccaggatggtctcgatctcctgacctcgtgatctgcccggctcggcctcccaaagtgacaaatatttttaaagacctagaatttggcctgactttctgtataatgtgatattttctagctctgtctttaaatggaattaaacttcttagggatgtttgatttagctctgagcagatttgttataactctgaggattttttctagctgatttttcttaagttctcatgttgagggttcctgtgaactcaaaggcccaaactctgttcaaatacacaccaagggaaatcttgccactgatgacacagtaagtaaaaggtgccaagggagagattctggctaagactatttcttctgtgagagaggacagagtctgtgtcagttatgatggcaactgttggataaaaagcaacacttttacaacagaaatctttttttaaacaatcaaatgtcatggctgcctgcactttctgtatgtgttgtgagcagtcatctaattccaaaacagccctaagcgtatgtcaaatcagtctacaagtttcctacctgtcttcattaggtttttctgatttgtctttgaatttgctggaaactcaatatgggaaagaaattgtgtaggacatcttttaattttttattccttggctcacaccctctgtcactgcagccaccacttttactcaggtgaggcttgacagtcccttgtctcagctgcacagagcatctcttttttccaaccttggggttcctctgccactatctgtgtgtctcctgtaaacttgctatgatggttaatactgcgtgtcaacttgattggactgaaggatacaaagtattgatcctaggtgtgtctgtgagggtgttgccaaaggagattaacatttgagtcagtgggctcggaaaggcagacccaaccttaacccgtgtggtcacgatctaatcagctgccagtccagctagaatataaacaggcagaaaaatgtgaaaggaaagactggcctagccccccagcctatgtccttctcccatgctggatgcttcctgccctcgaacatcggactccaagttcgtcagtttgggaactcggactggctcttcttgctcttcagcctgcagacggcctattgtgggaccttgtgattgtgtgagttaatacttaataaactcccatatatatatatgtgtgtgtgtgtgtatacacatatatatacatacacatacacatatattatatatatatatgtattgcattggttctgtaccgctagagaaccctgacttgcccagacattctcacacaggtgcaaaatggaagggcaaagacatacttaacatacttggatgggtgaccattgactaatgtaggacagtaactgattgataaattttcctctcttgagaactccttgtctcaggcaggcagttctgtggctttgtctgcatgcttccttagagtttacaggcagagctgtgttcaacatttgtagccttggagtggttttccttccttctctgtctcaaacttcccttctctcacttctattccctgggatttcttcccaaaataaactacctgtacatacacaaggtctcttctcaggttctgcttttaggggaattaagagagcaactaagtattttagtagctatttggttgttttaatatgcctttgtgacaaaccagtaggtcatacaagtatgacctactggtttgtcgatggctcggtacagtggctcactcctgtaatcctagcatatttcaagatggctattcagagggctggaaatacaagaatggctgaaaagcgttcacagacagcaacaaacaggagttgtgggtgtttccaacaaaaaaacaaacttgggttacttgaagccactaaatttgtggtaatctgtttcagcagcaataggagactaatacaccagcctggccccagtccccagatgatacacacggctgttggctagtagaattccagtggtattttatgtttttaacagttttgaaaagcatgttttttatatgaagcatcttttccaccctgtttcctccacatctcaaatgtccttgtccaattaaatgcaagctgtcataataaagaaaaacagtttgaaatctttaagattcccagtcaaaagagagactcataattatatataagtgaatgcagaatctattctaatggaaagatttggagatttcatacacacatgcacatacatatctatgtatacacatacaaatcaatatatattccagtacatgtagtacatattagagaatacgaacatatatgcatatgcatgctttagtttgtatgtgtatatgtgtatatatatgtatatttgtgtacatctatttgtatatctgtatctatatatcttcaactaagaggaaaaaagccaagccaaagataatcaacttccatatagcgccatgctaccaataactttttttcaaatactatttctagaaggcaatttgtcagtacctattaaatatgaaaatgtgtacctcttctggcctaacaattcactgttcaggaatttaatctaaagaaatactttaaaaaatgtgtaaagatatatgtatatatttaatattaattgcagtatgttgttttctaaaaaataaaatgaaacatatctgtcattatttaaataggttttagtttattcattaaatgcaaagagtgagattaggatgtatgggcaccaaagcatatccatgaaatattgggtgaaaaaaggaagttttagattaaaatatagaagataaaccataaaaatacatgcattttgatgtaaaggttttcttaggagcataattactttaaatatatatatatttaaaacacaaagagatggtgctatcatcaagatcagaagacaaaaaaacttaagtcagtggattttagtttccatttccagagttaaagtcatatacatgctgtactctatttctctgtatgtatgtttttttctctctcttttctaaaggagagaaaatatagatctttttgcattgtggagtttgggaaacggttaagtctctgagtacttctgagcattttaatctgttgatctcaccaaaggtcatcaattaatgctttttatttataaataacttctgttctttgtttttgagctcaaaatttaagaataaaatcaaacttttttgaggaggttgggattcaaagtgttaaggacttttactaagtaaatgattatttgtttctttttccattttaagtgagtttccatttataggtgaattacttccttatgcaagccagcttttaaagcaactatttaaacgaaaatagataaataaaatttttgaattttttttccagaaagaaaagaggaaacatgaatggagttatactgtgtgccagcctttgtcctagtgacttaaaaatggtataacatttaatgttcatgaatgcctattgagctggaatcatttcttagatctttccgaggagacacagggtccatgaagcacagggtcactttgccacacattcatttttttaattttaattaattaattaattaattaattaattaattaattttgaggcagagtttcactctgttgcccaggctggagtgcagcggtgtgatctcggctcactgaaacctctacctcccaggttcaagcgattctcctgccccagcctcctgagcagctgggactacaggcacctggcaccacactcaggtaaacattcagacatagaactcattactcttttctgtaacatggaacataaaatattctatggttttatgtaggctattagtggaattatttttcttaagcctatgttggctaaacccgatcacttatcttgggcaagtcctgttggtaatgtactaacacagaaagtgcagctatttagaacatctaaaatgataacttatgaaactgtattgctctaaaaaagaagaggataatttaaaatgtataccttgaacatttttctcttgaagactattattagacatttaatcttagatgctaggagattagagctttctatatctttttgccaaatctatatctgtcaaaatctgactttaggcatataccattaacataaattgatatttttggacaaagcttacattataacagatctttctaatactaagtaagcctccagatattttgctgtttagtttggatcttacatttgttctgtagttggataaatacatacctgaaatttagcaaggagtatgtaaacacttgataatattattagtgtgatatgaataatagcattgctccttctgtaagaactaaatgcccacatttatcagagttactacctaatattagagctagaatcacctaaagagattaaacaacaggagaaaaaaaccctgctctcaaggatttcacagtttggtgggagaaaaccttttccattaaaacagcaccctacttcagtgcctagtatatgctaggtgttattggggttaccttcaaatttgctcatttggtcttcataataacctgcctttggagggggattttcctcccccaagaatgtgcttgctttttggtcctttggaaactcctattcatccttcagaatttgttgagatagcttctttatgaattcttttggccaggtgctgtgactcgctcctgtaatctcagctactggggaggctgagatgggacgatcatttgagcccaggcatttgagaccagcctgagccacatagcaagaccctgcctctaaaaaagtaaaataaaataaatgaattctaccttggcctgcctcctctcagctgtcccctataggattaatcttcccatctcttaatgatttctgcatatatttctataacagaaatcaccttgagctgaaatttcatggttatctctctgtgacacaacagtgagatcctttgaggaagaggattttgtcctattttgctcattcaagtcaaccccaacactgttctactggatgatccattcaaatcttgaaaggcgaacgtctccccctcacggacagtaccggaattcaacaagtgaaagttcaattttattctaggaagcttctctagtgaggcagatttgccagtgtctgtatctttgtcaatcttcacggcaatcttctgaagtcatccctttgctttcttgcatcctccactagacagttgggtgagagatgactcttatttgattctctctctatctaaatagtaactgaagcctgtggacagtctataagtgtttaccaaaataaatcctccttaccctactccattttttaaaaatcaactttatttaggcataatctacatacaataaaatccacacatttcacacgcaccggttgatgactcaataaatatatacttctgtacattcattactcaaatcaaaatataaaatacttccatttccccaggaaattccctcatgcccttttgtagttaatctcccccattcagctgccactccagagatgagaatctccttttgttgcagtagtatagttttgcctattctacatattcatgaaaaattgaatctcatgatatgtactcttttgtgtctggcttcttttattcaattcgatgtctgtgaggttcatctatgttttgcaaaaggaagtaatgtattcttttttactgctgaatagtattttactgtctgaatatatgacagtttctttaaccattcacccattaatgacatttgaattgtacccagcttggctactatgaacaaagatgccatgagtattcatgtacaagttgttgttttttgtttgtgtttgtgtttgtttttgttttgttttgttttgtttttttagatggagtttctctctttgttgcccaagctggagtgcagtggcatgatctcggatcttggctcactacaacctctgcctcccgggttcaagtgattctcctgtatcagcttcccaagtagctgggattacaggtgcctaccaccacgcctggctaatttttgtatttttagtagagatggggtttcaccatgtcagccagggtggtctctaactcctaacctcaggtgatccacctgccttggcctcccaaagtgctgggattacaggcgtgagccactgcacctgacctcatgtacaagttttttaaaaatggatatttgtaacttttctcttgggcaaatacctgccagttagtaacttaatatggtaactatatgtttaattttatatgaatatgaaactgcaacgtgttttaaacatatctgcagtattttacactcccatcagcaatgtagaagtttcagaagctcactgtcagtcctttttcccactgctgataaagacatacctgagactgggaagaaaaagaggtttaattggacttacagttacacatggctggggaggcctcagagtcatggcgggaggtgaaaggtgcttcttacatgatggtggcaagagaaaatgaggaagatgcaaaagcagaaacccctgataaacccatcagatctcatgagacttattcactaccatgaggacagcatgggggaagccgcccacatgattcaaattatctcccacctggtccttcccacaacacatgggaattatgggagtataattcaaaatgagatttgggtggggacacagagccaaaccatatcattccacccctggcccctccaaatctcttattgtcacattttgaaaccaattataccttcccaacagtccctcaaagtctaaactcaattcagcagtaacccaaaagtccacagtccaaagcctcgtctgggacaaggcaagtcccttccacctatgagcctgtaacatcaaaagcaagctagttacttcctagatacaatgggggtacaggtaatgggtaaatacagccatcctaaatggtagaaattggccaaaacaaagggattacaggctccatgcaagtccaaaatccagcagggcagtcaaattctaaagctccaaaatgatatcctttgattccatgtctcacatccaagtcacgctgatgcaagaggtagattcccatagtcttgggaatctccacccctgaagctttgcagagtataacgcccctcctggctgctttcatgtgctggcattgagtgtctgcagcttttccaggcacatggcacaagctgttggtggatctacgattctggggtctggaggacagtggccctcttctcacagctccactagacagtaccccagtagggaatctgtgtaggggctctgatcccacatttccctccaacattgccctagcagagttctccatgagggccctactcttgcagcaaacttttgcctgggcatccaggtgtttccatacatcttctgaaatctaggtggagtttcccaaacctcaattcttgacttctgtgcactcgcaggcacagtaccacgtagaagctgccaaggcttggggcttgcaccctctgaaaccatgggccaagctgtaccttggtctcttttagcaatggctggagtagctgggacacatggcaccaagtccctaggctgcacaccacatgaggaccctgggcctggtccatgaaaccattttttcctcctaggcttccaggtctgtgatgggaggggctgccatgaagacctatgacatgccctggagacattttctccattgtcttggtgattaacatccttgttacttatgtaaatttctgcagccagcttgaatttctcctcaaaaaattggtctttttcttttcttttctgctccattgtcaggctgcaaattttccaaacttttgtgctctgttttaaaatggaatgcttttatcagcacccaagtcacctcttgaatgctttgctgcttagaaatttcttctgccagataccctaaatcatctctctcaagttcaaagttccacaaatctctagggcaggggcaaaatactaagagtctctttgtaaaacataacaagagttacctttcctccaattcccaacaagttcctcatctccatctgagaccacctcagcctggaccttatcattaatatcactatcagcatttctgttaaagccattcaataaatctctaggaggttccaagctttcccacattttcctgttttcttatgagccctccaaactgttccaaactctgcctgttacccagttccaaagttgcttccacattttcagatatcttttcagcaacactccactctactgttaccaatttactgtattaatccattttcacactgctgataaagatatacataagactgggaagaaaaaggggtttaattgaacttacaattccacatggctggggaggcctcagagtcatggcggaaggtgaaaggcacttcttacgtggtggcggcaaaagaaaatgaggaagatgcaaaagcagaaacccctgataaacccatcagatctcgtatgacttattcactaccatgagaacagtatggggaaatggcccccatgattcaactatctcccactgggtccctcccacaacccatgagaattatgggagtacaattcaagatgagatttgggtggggacatagggccaaaccatatcattcactaaaagtttggtattattaggctttctaattttaaccattctagtgggagtatagtggtatctcattgtggtttttagttttccctaatatctaatgatgttgagcatctttttatgtattactagccatttatgtatattcttttgtctattttaaaattgggttgtcttattattgagttgtaatagttctttatttattcatcgtatatatgtgtctttaatcatatatatgtgttccaatattttctcttttatttcatacatgtgttttatcatatacatgtattccaatgttttctcctagtcaacagctggctttttattttttgacagtgtctttgaagaccagaaagtttttattttaaaaaagttcaatttttcctttatgattagtattgtttgtgtcttatctaaaaaaaaactctgcatatatcaagattaaaagattttttttgttttcctctagaagtgttatagttttagctttaataatcaggtttattattacattttaaattaattgttttgcatggtgttagataagcattatgttttatttttcttcttcttctttttttttttttttgagatggagtctcactttgtcacccaggctggagtgcagtggcgcaatctcagctcattgcaagctccgcctcccaggttcatgccattctcctgcctcccaggtttacaccattctcctgcctcagcctcccaccattctcctgcctcagcctcccaagcagttgggactacaggcacctgccaccatgcccggctacttttttttttcttgtatttttggcagagatggggtttcaccatgctagcaagaatgggctcgatctcttgaccttgtgatccacctgcctcagcctccattacaggcatgagccactgcgcctgaccttattattcttcttatacaaatatccagttgcttcaatatcatttattgaaagaagtatcctttccttatgagattgcattgctgcccatgcaaattatcaattggccattatgtgtgagtctacttcaggactttctattccattgatctatgtgcttatatttaactttaccacactgtgttgattaatgtacttttttactacacattgaaactgccaactttgttttctttttcaaaattatttctctgttctggtccttcacatttccaagtaaatttttgaattattatgtcaatttttacaaaagtcttctggaaatttgaccagaattaagttaaatttgtagatcaacctagggagaataaacatcttaacaatatcaggtcttctaatccatgaacaaggtagacctctctcaatttacttatatcttctttagtttctatccatagtgttttatggttttcagttttctctgaatctatcatgatatatcattttcccccatttttctcttaatatgatgaatacattgaatttcttttgctagcctcatcttgctttcttggtataaagcttactaagttatgatgtattatgatttttacatattatgggatttaatttgctaaaattttgttaaggatttttgcttcaagactcataagggactttaatctgtaatttcatctcttgtgctatttatgtctggttttgatattagaaccttgtaaaatgagttctgaaacgttctgtccttgtcttgtttctgaaaatgtttgtataggattgctaccaactcttccataatgtcttgagttatgattgagttagcaaatgaaaaaatctgtgcctttaagtttcatcattatgataggacttactacaaattcagtttctgaataggctttctattttctcttgtaacttttgattatttagaatttttttaatttttttaatttattattattatactttaagttttagggtacatgtacacaatgtacaggttagttacgtatgtatacatgtgccatgctggtatgctgcacccaccaactcgtcatctagcgttaggtatatctcccaatgctattcctccccctccccccatcccacaacagtccccagagtgtgatgttccccttcctgtgtccatgtgttctcattgttcaattcccatctatgagtgagaacatgcagtgtttggttttttgttcttgggatagtttactgagaatgatgatttccaatttcatccatgtccctacaaaggacacgaactcatcattttttatggctgcgtagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccattctaagtggtgtgagacggtatctcattgtggttttgatttgcatttctctgatggccagtgatgctgagcattttttcatgtgttttttggctgcataaatgtcttcttttgagaagtgtctgttcatgtccgtcgcccactttttgatggggttgtttttttcttgtaaatttgtttgagttcattgtagattctggatatcagccctttgtcagatgagtaggttgcaaaaattttctcccattttgtaggttgcctgttcactctgatggcagtttcttttgctgtgcagaagctctttagtttaattagatcccatttgtcagttttggctcttgttgccattgcttttggtgttttagacatgaagtccttacccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcgtgtttgtcaaagatcagatagttgtagatatgcagcgttatttctgagggctctgttctgttccattgatctatatctctgttttggtaccagtaccatgctgttttggtaccagtaccatgctgttttggttactgtagccttgtagtatagtttgaagtcaggtaatgtgatggctccagctttgttcttttggcttagggttgacttggcgatgcgggctcttttttggtcccatatgaactttaaagtagttttttccaattctatgaagaaagtcattggtagcttgatggggatggcattgaatctataaattaccttgggcagtatggccattttcacgatattgattcttcctacccatgagcatggaatgttcttccatttgtttgtatcctcctttatttccttgagcagtggtttgtagttctccttgaagaggtccttcacatcccttgtaagttggattcctaggtattttattctctttgaaacaattgtgaatgggagttcactcattatttggctctctgtttgtctgttattggtgtataagaatgcttgtgatttttgtacattgattttgtatcctgagactttgctgaagttgcttatcagcttaaggagattttggctgagacagtggggttttctagatatacaatcatgtcatctgcaaagagggacaatttgacttccccttttcctaattgaatgccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtctgtcatagatagctcttattattttgaaatacgtcccatcaatacctaatgtattgagagtttttagcatgaagcattgttgaattttgtcaaaggccttttctgcatctattgagataatcatgtggtttttgtctttggttcggtttatatgctggattacattcattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagattctgttattggtctattcagagattcaacttcttcctggtttagtcttgggagagtgtatgtgtcgaggaatttgtgcatttcttctagattttctagtttatttgcgtagaggtgtttatagtattctccgatggtagtttgtatttctgtgggatcggtggtgatatcccctttatcattttttgttgcatctatttgattcttctctctttttttctttattagtcttgctagtggtctatcaattttgttgatcctttcaaaaaaccagctcctggattcattaattttttgaaggatttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttctttatgtacccagtagtcattcaggagcaggttgttcagtttccatgtagttgagtggttttgagtgagattcttaatcctaagttctagtttgattgcactgtggtctgagagataatttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcacagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgagtctgggtgctcctgtattgggtgcatatatatttaggatagttagctcttcttgttgaattgatccctttaccattatgtaatggccttttttgtctcttttgatctttgttggtttcaagtctgttttatcagagactaggattgcaacccctgtctttttttgtattccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctctttagttgatgcagtttcttcctagtctcgatggtctttacgttttggcatgattttgcagcggctggtaccggttgttcctttccatgtttagcacttccttcaggagctcttgtagggcaggcctggtggtgacaaaatctctcagcatttgcttgtctgtaaagtattttatttctccttcacttatgaagcttagtttggctggatatgaaattctgggttgaaaattcttgtctttaagaatgttgaatattggcccccactctcttctggcttgtagagtttctgccgagagatccactgttagtctgatgggcttcgctttgtgggtaacccgacctttctctctggctgcccttaacattttttccttcatttcaactttggtaaatctgacaattatgtgtcttggagttgctcttcttgaggagtatctttgtggcgttctctgtatttcctgaatctgaatgttggcctgccttgctagattggggaagttctcctggataatatcctgcagagtgttttccagcttggttccattctgcccgtcactttcaggtacaccaatcagatgtagatttggtcttttcacatagtcccatatttcttggaggctttgctcatttctttttattcttttttctctaaacttcccttcttgcttcacttcattcatttcatcttccatcgctgataccgtttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggcttgaatgtcctcccgtagcttggagtaatttgattgtctgaagccttctctcagcacgtcaaagtcattctccgcccagctttgttccattgctggtgaggaactgctttcctttggaggaggagaggtgctctgctttttagagtttccagtttttctgctctgttttttccccatctttgtggttttatctacttttggtctttgatgatggtgatgtacagatgggtttttggtgtggatgtcctttctatttgttagttttccttctaacagacaggactctcagctgcaggtctgttggagtaccctgccgtgtgaggtgtcagtgtgcccctgctggggggtgcctcccagttaggctgcttgggggtcaggggtcagggacccacttgaggaggcagtctgcccattctcagatctccagctgcgtgctgggagaaccactgctctattcaaagctgtcagacagggacatttaagtctgcagagtttactgctgtctttttgtttgtctgtgccctgtccccagaggtggagcctacagaggcaggcaggcctccttgagctgtggtgggctccacccagttcgagcttcccagctgctttgtttacctaagcaagcctgggcaatggcgggcgctcctcccccagcctcgctgccaccttgctgtttgatctcagactgctgtggtagcaatcagtgagactccgtgggcgtaggaccctcccagccaggtgcgggatataatctcgtggtgtgccgttttttaagccggtcggaaaagcgcagtattcgggtgggagtgacccgattttccaggtgcgtccatcacccctttctttgactcggaaagggaactccctgaccccttgcgcttcccaagtgaggcaatgccttgccctgcttcagctcgcacacggtgcgcgcgcccactgacctgcgcccactgtctggcactccctagtgagatgaacccggtacctcagatggaaatgcagaaatcacccgtcttctgcgtcactcactctgggagctgtagaccggagctgttcctattcggccatgttggctcctcccgattatttataaatttttaaaaatttatacattttatctaagttgtcaaatttatttacataaagttcacaatgtttccttattattttaagattggtgagattagtagtgtccttttatttctgatattggtatgtgatttttatctctcattttcttggttactcttattgtgtcatttttttcaaaacactaactatggctttattttatgtattgtttatctgtcttctattttactgatttctgcttttatctttattatttgtttcttctacttatgttcagtttaccatttactttccatttacttgtttgcttcttaaagttaaatattaaatcattaattttgacctttcttccttaatatagacaatgatgtctgaaaaataccttctaagccatgctttataagcatcccagaaacttaaacacattgtgtttttattattattcagctcaaaatacttctttatttctcttgcaacttctttaatccagtgtgtgttatacaaagtccaaatatttgaggctttctgccatattttactgatgtctaattcaatttctttgcaggcagtggacataatctgaaatcattcaataaaatgtactgagatttatttcatgggccaatgtatgatttattatttcaggtgtaattttgagtttttggatgtaaggcctgtaatgtgcattagatacagttgactgagaagatagtttagatattatattttcttactaatttttgtctacttatcttgagaggtttttaaaatctctctacataaatgtggatttgactatttatatttttatttctgtccattttacctcatgaatttgactctttgttattagttgcatatatatttagaattgttatgccttattggtgaatggctgcttttatcattgtgtatacttaaagtctgcttcacctgatattaatatagctcctccaccttccttatgtttactctttgtatagtgtagctttcctacctgtttatttctaacctacctctgcctttattttaaaaatacaccttttacatggcacattagggttttgtttctttgattttaaattttttatttttgatttttgttggtacatagtaggtgtgtatatttatggggtacatgagatgttttgatacaggcatgcaatgtgaaataagtacatcgtggacaatgaggtatccatccacaaatcctcaagcatttatcctttgtgttacaaacaatccaattacactcttttagtcatttttaaatgtatgattaaattatcattgactatagtcaccctattctgccatcaaacagtatgtcttactcattctttctatttttttgtacccattaaccatccccgtctcaccttcattccccaccacccttctcagcctctggtaaccatccttctactctctatttccattagttcaattgttttgatttttagatcccacaaataagtgagaacatgtgatgtttatctttctgtacctggcttatttcacttaaccatctccagttccatccatgttgttgcaaatgacaggatttcattcttctttatggctgaatcagactccactgtgtatatgtaccacattttctttatccattcatctgttgatggacatttacgttgcttccatatcttagctattgtgaatagtgctacaatctacattttctttatccattatctgttgatggacccttagattacttccaaatcttagctattgtaaacagtgctgcaacaaacatgggagtgcagatatctcttcgatatactgatttccattcttttgggtatatatacccagcagtgggattgctggatcatatagtagctccatttttatctttttgaggaatctccaaactgttttccatagtggttgtactaatttacattcccatcaagagagtataaggtttcccttttctccacattctcaccagcatttgttattgcctgtattttgggtataagccattttaactgagatgagatgatgtttcattgtagtttttgatttgcatttctctgatgatcaatgatgttgagcacttttcatatgcctgtttgccacttgtatgtcttcttttgagaaatgtctactcaaatcttttgcccatttatggattcaattattagactttttcctatagagttgtttgagctccttatatatctggttattaattccttgtcagatggatagtttgcaaatattttctccaatcctctgggttgtctcttcactttgttggttatttcctttgctgttcagaagctttttaactccttgtgaaccaatttgtttatttgtgtttttgttgcctatggttgggagatactgctcaagaaatttttggccagaccaatgtcctggagatttcccccaatgttttcttgtagtagtttcatagtctgaggtcttagatttaagtccttaatctagtttgatttgattttttacatatggcaagagacaggagtctgctttctttcttctgcatgtgaatatctagttttcccagcatctattgaagagactttattttaccccagcatatatttttggcaccttttttttttggtccagtatgaaaatctctgtcagttgatgggtattagtttatttacttttaacataattgctgatatggctgaattcctatcttgctcctaacataccttcttttcggtttatcaacattttttaatactcagtttttacttgctctagtagtttcctaactatacctcttttattgtattttaattggtttctctatggctaactgtatgcatccttaacttaccagaattaatttagaattaatattgtaccttttaaaacttcaacatataacacaatacgtttgactttaacctttctactttccacttcccaatatatactttccacttcacaaatataatgaccttgcaacggtataaatccaatacttgtctcctaattctttgtgcaaatgctatcgtagcttttatttctatatacatataaatttctgcttctaatattatttttgctttaaacataaattacattttaagtactttttgaaaagaaaataaacctagtcttttgtatttactcatttatttactatttctggtgtatttcattccttcctgccgatccaaattttcttggggcataacttccctttggcctcatggttttccctttagaatttctggtcatggcaattgctggtggaaaatgtactcgggttttattctgaaaatgtctttattttacccttatttctgaagaaaattctcgctggatattgaattctctattgccagtattttctttcaagctttcatatcttacatcattgttttttggcctgcattttttaaaaatgtgtaataaatttatctttttttccctacaggtaatgtggggttttttttttcctctgtctgctttcaagattttttttttcatttttgttttttagaagtttgactattatgggcataactatagatctctttacatttattcttaagtaagttgtaatttcatcaaatttggaatattttcagccactatttcttcaaatatatatttttctgtctcattcacactctccttttctcagggactcaaataaatgtattttacaccattgatattgttcaacagacccctgaaatactgttcatttttctttaatctttttaacctcattacttacattgaataaattctattgattgattttcaatgttcctgactcttttttttttttttgctgccatcttcaatcttctggccccatctaataaaatttatttgtatttcaattactagattttttatttatagagtctccatatgatttttttatagtttccatttttctgtggaaactccctatgtgttcactcattaagatcagatttttctttaatttttgaccatatttataaaagcagcattaaagtctttttctattaagtccatttttttggccatcttgggtttgttatctatttttttcttttttttttttcttgactgtagagcactgcttctttgtatgactaaggagttatgtactgaacactgaatattggcaatcatatatcttaaagattctggattttgttagttttctccaaagaatgtggattcttattttaacaaggaattcatttgtttttaactcatgtagggtttggtataattgtaagcctcggatggtcctgcctggttgcaggtataagtccagcccttattcataaaccagcagaggacctccacatacaccttgaggaccactctctgcaatctccttatttttccgatgccatatttcacagactctagctatttcagcagccctaccctctgaattctgcctccttagttcagttagactgttaagctatgctgggacccctgttctctgtgcagcaattgggaaattgtttataacagagattcagggaagtgatggaactaatcttgtgagttgtctttctctaggggtcacagtcctctcttgcccgagttccattgcccaaaaacagttgactcacatatcttgtctaattttataggtgtttattgtggtagggctaatttggtgccagttttttcattcatgtctagaagtgaagttccactacttctgtctttttttccccctcatggcacttattaccctctcacatattagaaaatttacttatatgtcagacattaatagattattatctgcctcttctcaccaccttaccagaatataagcttcatatgaataaaggtatttgtctgttttgttcactaatgtatctcaggcacctagaacagtgcctggcacgtagttggtgcttaatcagtatattatctcagtcattttacaaataggagatggctcaaagggtgcatctatatgtattttttaactttcacattaataagtggtaaaacttgcttttgcatttgttctcaaacttctgactcaaaaacctatgttcttctcacagtagccttcttctttttctagtttctaaagtaagacagagaagaggaaatattaaggaataaaaaaactcggaggcaaaatgcacaactatgtctccatgaacttcctaagaagaggctaattataggtttatttactaactaaatacaatttattctacattctaggtggaaagctctgtacacaatgattaagacttattcctgggtaaggatattagtgaatctgattttggaattgtagttttataatcttatttatttgtgttttactttttaaaaactaaatatgatttttgaatgagaaattggagaaattgaagtctagtcatggcctagtctagtcatctatctattagctgtgaaactttgggtaaatagtaacctttatagacctgttattttcccccaaaattgttctagtaatacatgtttattccactacttctttttaatgtagatgaaacaagaaaaggaattccaaatgctttgaaaattataaactgcaatgtattaaatattatctgagctgtttaaaatttaaagttggtaagcctttataagtagtatgttaaagattacaagtaaaatgatatgtaaagagcagcagcagtattgaaggacatgtgtttattttgtgctaaattgaactttgcagcaggccttaataaacctaaaccagaaaagaaaaatttcttttacttatttgcttgaaaagaatgttataagacaaatttacttcagatttcttcaaaactttccattaaacttgttgtgggtataatgagggaaacttttactaatataaaaatataagacatagagtaaaaatgaaaagctatttcagggtacaatttcagaaaaggatttaagagtttggatcatgtttccacttcagagctccttcaagggattgaggggaaatggtgtagttttgttttcagttacaaatcggcatgatatacattatgtaaaaattatgcgagattaaacaccttttagttgcccaaggagaaatgcttctttctttcacatataaattcaaccttggccaggcgtggtggctcaagcctgtagtcccagcactttgggaagtcgaggcaggtggatcacttgaggtcaggagttcgagaccagcctggccaacatagcgaaaccccgtctctagtaaaaattcaaaaaattacccgggggtggtggcatgtgcctgtagttccagctacttgggaggctgaagcaggataatcacttgaaccaggaggcagaggttacagtgagccaagattgtaccactacactccagcccgggcaacagagcaaaacttcatctcaataaaaataaaaatgaaaataaaaataaattcatccttaataattttctttgttgatatgaatacttgttctgtttgatttagaaagtcttgcataattcagttgtatttctcttctcttcccttgggaatgcaatgaggaactggttatatatatactttgtaaagaaaatgtggtatcttagactaaaactactttagcaaatagtagttggtaagttaacaccaactactcccatccagaaagaaccaaccacataattctgggtttagtatagcatttatctcggcctctgagatcacattttaaagtgttaaaattgaatcttctctttgggatgttgcggtgagaattgttttttaagggaaaaaaatggagaaaaaatgggcaaaggaaattaacaagtaaaatctaaatagcttgaccaaaataaaattcgtttgaaaagaataaaaattaatgctttcaacctagtacaataactgagaactagataaatctatggactaagaggtccttgtagatactgcatgtgctaggatgaataaaagagattggaattagcaaatagattatgtgtcagtaaatatatgcttttaaattacttgaaggcacacaaaacagtttgtttaaaataacttgaagatcttagacattccctctcaaatgttatttacccactgcctcgctttgtttcagaaagctgtattccattcttttgctagaatgtaaaagtacacccatcatctttgtccctggtcctttaaggttaagtagaacactgacaaataatattcctctaatggagtctaaattaggagtaacaccttctcttataatgataaaatgagcactgagacctcaagattttaaaaagccatcataaggggtagtaaaaacggttacaatcactatactgcattgcaaattgtggtgactttggtttggaatatagtagtatgtcagcaacagatactgcttactctaaatcaacattcctttttctaacttactaaagaatctcaattttctacaggtatccacctatgcctcatgttacttggggagaggtgaccctatccttgcctcaggggcaaatattagttgggacaaaccagttatgataggtaatctcatcctcatctgccaaccctgccccactgacccagagttgggtcccatgcccagcatgggaatatgagagcaggttttttttgctttttggaaaggtttccttctttttaagacaaaggtgctagaagtaacggcatctttgtgcttccatgtggatgtaacgtgagctgcgatagctgtcttgcaaccctggggagagctatctgtatcagtttattagggctgccataacaacgtaccatggactgtgtggcttaaataacagaaatttatttgctcacagttctgaaggctggaagtctaagatcaaagtgttggcagggttgctttctcctgagggctcttgccttgactcttctcattgtgttctcacatggtcttttcctggtgcacgtgtgcacctgttgtctcttcttgggtgtccaaatttcctctttttataaggataccagtaagattgaagtaaaacccattctaatgacctcctttcaacttcatcatctctttaaaggctctatctctgaatagttatagtctgaggtactggaggatagggcttcaacatatgaattttggggagaggcaattcagcttataacaccacccatgggacaaatgagctcgctgacaatggtagaaaatatcaatggaaaaaatctgggtcctggatatgagataatatatatccttatgctgtgtaagcaagttgaatatgcattttctcttacttgaaattgaagacacataccttatatctaagaaccatggaacaaacaaaaaaccatcaatgtcactcctcttcctagactgcagagtttcaccagttagtctgtaatattgaaagagcatctggaagttcttccagttggagaaatagctgcatgtgttgaagaaccttctcaagtggcaagaaatcttcctcttgtagcactccccaggaaagatttggtattctttggacccagagaaaatgcttcaagtttttgaagctgcaaaaagactcaagatagttacatacagatttaaagtgtgccaatggaaagaatgttgtattcgggaaatacttagtttcttttatgtgcattttccccatgacaatgcatgaaatgtgaatattaatatttagacagccccttaatggttagatagctagcaaccaggctctgaatactacaagtaaaaaaagttctacagaaagctatttcttataaatattttattaaatggctaatgaaaaataaatagtctgcatttatctagttattgcacaaaacattttcatgcgcattattttagtgaatcagtacaccagggtgggatttttgtggacttattttgcataccaagaacttacattaaattgtccattcaaatgaataataagagtaggagccaggaaccacaggcagattttctgtctctaataggtagaaatcccaatttgcaaaacaaatacataaacaacaaaacaaaatataaagcaaccataagcatatttttaaagattcttttatcaaatgacaggcatttttgccaactgggaaaaaataatatggaaaaatgttatttggctttaaaagaaatgaaaggtataaaagtagaatcatgaaatttctaaagtaaaaaatgtctggattcgggcaagatggcccactagatgcagccaggtagaactgctgccactgagggactgggatgactggcacactcctaaaagatcttcagagggaaggcactgacagtgaatgcagaaaaaaacacagaaactgggctgaaggggaagaagctgggaaccatgtgtggggcttctgcacaccaggactcattcttggcccccaattactccaggggaatgggcgagttgaactggcagcaaacaactcgctctagccatgagcctctggaatcccagcaagaggaaacccctcaaccactagggacacttgagttggcagggagagctgcttagagaagtggtaggggcagcaggccagctgatgcagagcctacagggcttgctgtaggagcatttgtagtagagtagggccaggggtgcccatccctccaggatcaacttgctcccataggagactttagccctaggggaactgttggaacaaaattctgcagtgttgtcttgcccttcagatggggtggtgtgacctgagcaccccttgttccactggtttcttctgggttcccagcctggctgcacctgtttgcattgcagcctctggtgccctgggggcctgcatcatagcttctgcactggtagatcattcctgaacagtggacagcttcagtagggcagtcctcactgccatacaccagtctgcccactcccccttcccactgcagcttccccagggtccatggccacccccatattgctttgtcaccatgtgtggtggggggacactttgccttccctgccctaccagggcacatggatgtgtggaccctgccagcaggagtgcactctgccttccctcacccaccatactgccattgaagttggagccttggcaagcacagagcccactagccccacccctgcaccaacactgggagtgaaactaggcacacagaacaatagaccctcccctgccctgagcggccacagagggtacacaaagacctgtgcccgccagtgcccctcctctgtgctaacaccaccaacaatgcaaccatgcatacagtcaccaacaggatgccccctgcccacaccaatcataccacctttgccactgctgtgaacacctgcatgaaggcaggcaccccaacatccactagcatcctgcgacagccgacgggtgtgcaccccaccacactgccactgctgctggcacatatgaatgagaatggatcgcactgccatcaccctatgaaatgctttgtctggcagcatgtatcagaatgcaatcaacagtggccaacaagcacttaggcacccctgccccatgcagtggattcctaacctcaaggaaccagagaacaaagttagggcctgttataaatcctccagaggtagagcacacagtctaggagttgggagatgactgttggtcccctaaaatcttccaaaaatgaatccagtagactggacccaccttataccacaagcaaaccctcaatgccatcaaataggataaaagaaaaaaatctaaaggacagcaacttcaaagattgaaggaacaccagtccagaaacatgagaaagaacccgcacaagaagcctaataacaaagagccagagtgccttctttcctccaaacaaccacactacctctccagcaagggttctgaactgtgctgagatggccaagatgacagaaatagaattaagaatatggataggaacaaagatcattaagatgcaggagtacattgaaaccaaatccaaggaagctaaaatcacaatgaaacaatacagaagctgacaaacaaaatagccaatattaaaaagaacttaaacaacctgatagagtggaaaaatgcactgcaagaatttcataatgcaatcacaagtattaatagcagaatagaccaagctgacgaagaatctcagagcttgaagactggctttctaaaaataagacaatcaggcaagaatacagaaaaaagaataaagacacataaacaaaacctccaagaaatatggcattatgtagaggccaaatctatgactcactggtgtccctgaaagagatggggagaagagaatcaaattggaaaacacatttcaagatttcagtcatgagaacttccccaatctagctaaagaggccaacattcaaattcaggaaatgcggagaaccccagtaagttacttcacaagaaaatcttcataattatcagattctccaaggtcaaaatgaaagaaaaaatgttaaaggcagggtgagagaaaggtcaggtcaggtcacctacaaagggaagtccatcagaccaatagtggattttttagcagagacccaacaagacagaagagattggaggccaatattcaacattaaaaaaaaaaaagaaattccaaccaagaatttcctatccagccaaactaagcttcataagcaaaggagaaataagatcccttttcagacaagcaaatactgagggaattcgttaataccagacttgccttacaagagcttccaaaggaagcattaaatttgaaagactaatcagccactacaaaaacacacttaagtacacagaccaatgacactgtaaagcaaccatacaaacaagtctgcataataaccagcaaatatcacgatgacaggatcaaatccacacatatccataccaactgtgaatgtaaataggctaaatgccccaattaaaaggcacagagtggcaagctggataaaaacgcaagactcaatggtatgctgtctttaagagacccatctcacatgcagtgacacccatagactcaaaataaagggatggaaaaagtctaccaagtaaatgataaacagtaaaaagcagaggttggaattctaatttcggacaaaacagactttaaacaaagattaaaaaaaagacaaagacattacataatggtaaagggttcaattaaacaagaagacctaactatcctaaatatatattcccctaaccgaggagcacccagattcataaagcaagttcttagatacctacaaagagacttagataaccacacaatattagtggaaggcatcaacaccacattgacagtattcaacagatacatcgagacagaaaattaacaactcagcactggatcaaatgggcctgagagacatccacaaaactctccactcaaaaacaaaagaatatgcattcttcttatcaccacatggcacatactccaaaattaaccacataatgagacataaatcactcctcagcaaatgcaaaagaactgaaatcataacaactactctcttggaccacagtgcaatcaaattagaaatcatgactaagaaatttactcaaaagcatataattacattgaaattgaataacctgctcctgaatgacttctgggtaaataattcaattaaggcagaaatcaaaaagttccttggaactaatgagaacaaatatacaacacatcaaaatctctggacacagttaaggaagtgttaagagggaaatttatagcactaaaagcttacatcaaaaagttagaaagatctcaacttaacaacctaatatcacaatgaaaaaaactagaaaaccaagagcaagccaatcccaaatatagcagaagacaagaaataaccaaaatcagagatggagacatgaaaaaccattcaaaagatcaacaaatccagtaggtggtttttaaaaaatattaataaaatagatcactagctagactaataaaaaagaaacaagagaagatccaaacaaatacaatcagaaacaacaaagggaatattaccactgacccgacagaaatacaaataaccatcagagaatattatgaacacctctatgcacacaaactagaaaatccagaagaaattaataaattcctggatatatatacccttccaagtgtgaaccaagaagaaactgaatccctgaacagacaaataatgagctttgaaatttaatcagtagtaagtagcatatcaatccaaaaatctcaggaccagacagattcacagctgaattctagcagatgtacaaagaaaagctggcaccattcctgctgaaactattccaaaaattgaggaggggggactcctccgtaactcattctatgaggctacgatcatcctgataccaaaaccttgcagagacacaacaaaaagagaaaacttcaggccaatatccctgatgaatattaatgcaaaaatcttcaagaaaatacttacaaactaaatctggctgcgcatcaaaaacaatatcaactaaaatcaagtaggctttatctctgggataaggtttagtcaacttatgtgaatcaataagtgtgattcatcacataaacagaactaaagacaaaaaccatgtgatcatctcaatagatgcagaaaaggcttttgataaaattcaacactccttcatgtttaaagctcttaataataagagccatctatgacaaacccacagccaacatcatactgaatggccaatagctgggagcattccccttgaaaaccagcactagagaaggatgctttctgtcactattcctattcaacatagtattggaagtcctggccagagcaatcaggcaagagaaagaaacaaagggcatccaaataggaagacaagaagtcaaaatattcctgttcacagatgacataattctatatctagaaaaccccatagccttggcccaaaagctccttaagatcataaacaatttcagcgaagtctcacgatacaaaattaacatgtaaaaatcactagtatgcctatacaccaaccaccattatgcagagggccaaatctggaatgcaatcccattcacagttgccatgaaaataaaaaaatacctatgactacagctaaccagggaggtgaaagagctctacaatgagaactagaaaacactgctcaaagaaatcagagatgacacaaacaaatggaaaaacattccatgcttatgtatagaaagaatcaatatcattaaaatggtcatgctacccaaagcaatttatagattcaatgctattcccatcaaactaccaaggacattcttcacagaactaatgaaaactattttaaaagtcatatggaactgaaaaaaagcccaaatagctaaggcaataaaaaaaaaaaaaagctgggggcttcacgttaccagacttcaaactatgctacagggctacagtaaccaaaacagcatagtactggtacaaaaacaggtaaagcaatggaactgaatagagggcccagaaataatgccatatgcctaaaaccatctgacctttgacaaagctgacaaaaacaaacaatggggaaaggactctctattacaatagcaaatcctgtttaaatgcccattaatggtagattggatagagaaaatatggtacatatataccatagaatactatgtggccataaaaaagaatgagatcatgtcctttgcagaaacatggagaaagctggaggccactatccatagcaagctaactcaggagtagaaaaccaacaatgcatattctcacttacaagtaggagctgaataatgaaaacagatggacacatagtggggaacaacaaacacggggcctacaggagggtagagggtagaaggaaggagacgataaggaaaaataactaataagtactaggcttaatacctggattactaaataatctgtatgacaaacccccatgacacaagtttacctttataacaaatctacacatgtactcctgaacttaaaataatttaagtaaaaaaaaataaaaaatttgaactgaaaaattctctggatgtaatacatcagggaatattttaatattttttttgaaaactaataatataagatatcttaataacataaagagaaaaaagacattatagacaggggagctaaaataagaatgattactgaactgaatacaagctagaaggctataaaacgacttatttcatgtaacagaagaaaaatgggccaggtgcagtggctcatgcctgtaatctcagcactttggaagggaggctgaggtgggtggatcacttgaggtcaggatttcaagaccagcctggccaatatggtgaaaccctgtctctactaaaaatacaaaaattagccaggcttgatggtgcatgcctgtagtcctagttacttgagagactgaggcacaagaatcacctgaacttgggaggtggaagttgcaacgagccaagattaagccactgcactccagcctgggagacaaagtgagactccgtcttaaaaaaaaaagaaaagaaaaaaaattggaaaactcacaactgtcaaacaataatcaataagaagcgattagatctgggaccgaagatcttattagaattgtgatcaaagagtaaaactcaatcattagaattttatttggttccccttcacaggtaccatgtaggaggtaccaaagaaccagacatctgtaaactaaaattttatttttctgttctcaactaattgtgcaactgtcttactgtcaaatctctaaaataggtggtcaaactaaatcttagactcttctaagattctttgaaattgtgatgtggagtagaagcaaaaaatatcaaaattaatgcctccttatagagcatccaaaaatgttttctaactgcatatttgatgcaaatgtacccaaagaatttatcgtattatccagacaaattatattcaggcatatatatgtatgtgtgtatatatgtgtgtgtatatatacatatagatatatatgttttaacatttgaaatgtaattcatgacattggaaccatttttgtattgaattagatgtaaaataaattgatactgattccattttacaaaaaagttaccatatagttaaactataataatttccattgatggaaattaatgccactgaattatgtaaaactgtaaaaaatataggcatgttccttttgttttatttcagaacatatttctataccaatgagtaaataataattttatgtttctttgtggtaatcagaaaaaaatacacactactcttttatttatgcggatttaattaccatatttacatattttctgccttttgattggttcatacatctgttcttaatggttctatgaaaattatattaaaaccacaacgtcaaggttttgatgagtagctcagaagcaacccaagtacaagacaaacattagaatataatgcttttcatggctagtgatggagtggggccatttatcatagagccaaaaaagcaaaaaattagagatacatcagcttccatgtttgagatttttaaaaatagctaaatgcttccaaatgtgcaagtttacccaaagctactttaattttactctgtttctatactaggaataaaagtttccaaggatagagtaatactttcttatgaaaattccaactgatcatactaaatatcaggtcaaaaatcctgtttaaaagatatgagatggtagtgattttcttgcatgtgagcaacatgaaaatataaagacagatcttaagaactattcaatcaacacgtcataaacagtgtgttcaaaatttagaaaatatatttgactatcttttgaatttaggctggttcagatagtaacctatcaagaaagaatgaaccagtttaaggaccatggaataagggaattaggtaagatgtaaattggaaattatagatagcactgattgcttaatgctgaaataatcaggaatacaaatttatcctgtgtcttcttgagtggttcaagtgcttctcccagatggaacactgaagtgccatccttcagcttcacatcgctaatatgtggagattcaagtagccaggtacaatagactcaaataccattattctgttattctaagatacataatctaaatacagaataataaagcaaatgaaatctcattataactttcaattataagattcttggtcattgtttgattttgttttgttttattttgatactgagacaaaattataactaatataagcaccaagtcaacaggaaactgagtattcactaagaatggctaccattccctagtcacctttctaccatcaccattccaaaattagttaaatcaagaaagaaaagataaaagggaaaaaggatttattgtttatcagttcttattccctatcctttcctgtttaatacaaatggtattagacacatggaaatttttttaaaaaatacgtaaagaaggatatgattgtatgaattggttctaccactttggagagcaatttggctcaatgacaaatatctccaaaacattatattgagagaaaaaaattgacagcatattaaatcttattattgggtacataccaatataagaataaaacatgcatgtaaacaataaacatgaaatcagaatggtgtttatgttggggaggaaaagaggagtagaatatccagagagagaaaaacacagaaatattttattatgtttataatgattaatatttttataccaagtgttaggggtgtttattacagtactattttacattttggcatttctaaaatattccataataaagtttgaagaaagcaagactatttagctagaagctagaagagtgatttagtttttatgtgaagcatgagaactagctgttttctgcctccataaatagaattggaaatttaggctaactacaaagtttactttcccactttagtgagttcttataggttgcaaagaaaatttatgtggctttctgtgaacatcgtgatgatgaggctggattcttatctttcttaaggagcttgggtggtcctggtttaaagtgggcgacatcgcccctctgctcctctctgactttttagttcttattgagagattacaatcgtttaagatgagtaagcagaaaagggaggaaagaagatgtatgagtataaatatcagagattaaagcccccaaatgaggccagataataaacatcagagaaatggtctctttcatttttgtcctttattgtagcacatttctaagccgactagatttatcttcaattttcatttcattcaatgttttgaatctttttttttattgtagaggcagtctcctggaaaaagaccttaaaaatatccccaaatattcagccaaatgacagagtcagttggaaagagtgcagtcattcacttttccatttctgtgtccagttgagattgttgcaggcaatgcccgtgttcattatctcttttactgagacaagatttaacctcacacaacatctggaaatatcagaccttttactttctggtatttctggatgagggaccacatgcacagactctattttgtaagtactgtataggaagagcaagcattttttcaataccatttatcaattgttaatgcttaaatttctgttttggtgtgacatttctgaaattcagcctcttctgttacatgtttagaaatcaatgtgcatgtttatatggacaggatggagtttgttttatttcttaccccctgaatatttgctcactaggtctgctaggggacctgccagttagagaaaatgaccattatgaaactaaggttttttgcattaattcgttatgcagtatagacatatttcccagaaaatcaattttgccaacccggaaataatgcaagcaccatgactgccaggatttttgtctgttgtgtgtgtggcttttttattcccactagaaataaacaaaaatcgttttgacttctcagtaatgaatgtttaacctaaatggtaagggatgaagtcatttttttaatgttagtggaagttggaaaatccagaagtgcctatcatataatctcagttatttctacaatagtacgaagtttgccgttttcttgcatcttgtacacacacacacccccacacacatatctgctaaggaggaaaataacatatagcatgaaccaggttattcaataacaatctggaaaatttctaacttctttatgctaggtcttccaaaatattagctatgtatttattcctgatactattctgtttcaatatgcttctccatgggtttggcttaatccacgtgtatatgcagtgcagttaaatggtagagatattttaaggctttttctaaatttctttcccaaacaataagacttcgggttcataagtgagcttcattcctctctgtctccagcatgataacagtaggatgatactcaagaccacacaaagaagaatccaagagaagaactagagagaaacaacacaagcatgagatcccagttgactggggaggtgacagtaatgtggattggactctggaaggtctgagtcttaattctgcatttgtcagaagtcagttgatgaactgggaagttacttagctcaaggagtttactcttcatctgtataaagtttgggaataaatagtctgaggttcttataagttctcaaattctgtgagcctatttctactccacttttataaaaaaaatagaaattatccaaagcaaaatgttgcccttttttaagacactttttcttacttttttttttaaatcagctgtccttcaggtttttaaaaaatctgtcaaaattatttttagttttagtaaaaaataaaactttaacttctaaattttaagaaattcttatttgtagaatcacaaatcaaaatttcctgagattctttagtttatttcttttcttatttattattaaatcattttttacaagatgcaaatattctacagcctgttcttttaaattggtatgtgtaattgttcagcatgttcagcttattaactgctaggaataaggctgtcattcattttgatcaataaaacaagtatctttactttggaggaataatgtatccaaaacaatcaacaaaggggcacttgtcaaccttttagctttggttaaaagaaaaaaagtagactcataacacaccactctcgaccacagtgatctttcccctgagctgcaacgattgtgaggcatattttgtgaaagcaactcgtatgctctcctccagtggttgccatctacacttcaatgtcctagtcctccagcacactgagatgcacccctactctcgtgttcctctagaaaaattattattataaaaacaaaatggactatgaaaaatagcctctttgaacacaaattaatttggagtagactttatatagttatgagtcaatttttcttccacagcaaaacacaattccctttaaaatataaacaattggtggattttataataattttaaatccaaaaccaagtaatacctttgtacatgtatatgtgttatttacacatgtatatagtatgtatatgttatttacatgctatttacacagaaacagagagagagattttaagaaatgaaggaatggttcataaaattgccggggctggcgagaccaaaatctgcaggacaggctgcaggctggcaagacctagggaagtgttaatgctgcagctccattctgaatgcagtctgaaggcagaatccccatttcattaggggactccagtatttttctttttcttttttttctttatacgttaagttttagggtacatgtgcacaatgtgcaggtttgttacgtatgtatacatgtgccatgttggtgtgctgcacccattaactcgtcgtttacattaggtatatctcctaatgctatccctccccgctccccctaccccacaacagaccccagtgtgtgatgttccccttcctgtatccatgtgttctcattgttcaattcccacctatgagtgagaacatgcggtgtttggttttttgtccttgcaatagtttgctgagaatgatggtagccataaaaaatgatgagttcatgtcctttgtagggacatggatgaagctggaaaccatcattctcagcaaaccatcattctcagtatttttcttttaaggccttcaagtgattagatgaggcccacgtacattagggggggtaatctgctttactgtgctctattgatgtaaatggtaacttgagctaagaaataccttcacagaaacatttaaactctgtttgaccaaatatctgaggactgtgagttgacacataaaattaaccatcacagtgctcaagctaaataacattattctttgctaatttaagaaataaactggccagtcacagtggctcatgcctgtaatcccagcactttgggaggctgaggtgggtggatcacaaggtcaggagttcaagaccagcctggccaacgtggtgaaacttcatctctactaaaaatacaaaaattagccgggcatggtggtgcctgtaatcccaggtacttgggaggctgaggcaggactccagcctagtcaacagattgagactctgtctcaaattaaaaaaaaaaaaaagaaagaaaagaaagaaactaacacatccagcaaatgtcagtgtggtacagaatctatgggtggtttaggaaatagttaccagaatgaaacttttctcctccacacattaagctttttgctctagcacactctataaatatttgtaattctgaaatgtttttcatgaattctgaaacaagaattttgaaggagcatatgtcttctggaataatttttcaacactggaaatactgatttacttatgctgtacatgaggaagttcctagaaatgcacttttaactgaaagtgttcaagggctgagggagagatgggctttttacattgtatattccttgattctaactcaattaatttaaaatgcagggagtttagtgtgttaataaaagggatttcaggtgttatgggaatagagtaaaatgatagccagcctgtgagggagggaacaggggaaggaggctgtccagggacctgcacatctgagctgagaaactgtaaataacatggtggttattaaagtggctcacgagttaggtcagctaggctcagatccatgctctggtactaaataattgtgtcttcagaaatttatttaatttttctagtactctgtcttctcacctataaacatacagtttccaaagtgtagaaggattaaatatgaaaagtacacctaacgtacctcacgccttgtagtcagtggcacatagtgattaatattattaattattattattattgtcactaggtagaagatgagggactaaaatgagcatgtgctagttacattgatttgttttcagtgtctacatgggattggatataggtgtcagaagacacaatcgaatcgtaaaagaagaagaaaaaaaggaaatgattttctgaaatcattgtacattttaatgtgtttaaaatgttaagtaggaaggatgtttttgtaagagactattctgtaagatgtaactttaggcaaagtacaattgcttttaataatttatgataggagatttaaatgttccagttaatatatctcttttagatagtcacctggaaagtagcatttttattctagagatgcctccattgaccacaatgtttttatgtcatcaatttttctgtttgtattgtttcgttagattatgtcttttatgtttcttcggtgtcaggaaattgtttacttttaaatgcaattctgaattttgcgagctaaaaaaccagctggaaacaaatagagtgaacaatatggattatgtatttttttagtttttagtttttggtcatgtggcttggttctgatttcaaggagtggctgaaaaattaagcaggaaagcaattttcaaggaagtttaaaaaaacattttgtggtagaatagttggaatatgtctttaatatcaaaatgtaacaaactggaagatacataataaataccccttgttttgtttttaaaataataatttcattaatttatatagaaacaaacatccttttattcctttttattgaatatatacaatttaagtaacattactcatggcaaaacgctaatggccaaaccagaaccctaaatccagcagcaaaaaaaattccacctatgcacgtgctttttcctttctcacacaaacttatactttattgacatcgaaaagatataatcttaaattaggatggacttattatttttatatgcacaaagtgtggcagcctttgcctatgtctaacatattggaaacatagttaataggagaatgagccctggaccagaagccagaacacccaattccggcccttgctctacacgtctcagagttatcaggagcaagatgcttaacctcttgatgcctcagtttactcatctataaaacctggctaacaatatatatcatcattccctccaaaagttgtcataaaaattaaatgtagttgtacattttgaaagtctgaaaaatgtaaaataccaaccaaatgctaggtactgcaatatatgttcttcatacctgggaaaaaagagtcccaactaacaaatgcattttataagcccctttatttctaaaattaagtagatgaattatatcccagttattttagtttgttttctctttgtcatcacatgtgtaaaaagttgacctgttttaactgtagttaaagatacaaaaagctcaggttttttgacacagcctttttgaatgtagtaaaatgcagaggccactcacactatcaaaccaattctgtaggttgaaatagtggtctacactaattaggtgtgtcaatgtagagagaaagtctgtatgctctgaagcctatctattcatggagtattatctattttacccacaaacaggaatttccccacaatgtactgtcatcacagagcaattaaatatatggtttgcatacttctcaatggtaaatattttgcctggttcataaggtcgtatatcatgcatttgtttctatttctggctagaagagatggatataataattatattcaataaaactggaatgtaatcccacctatggtaattttttttcaaaacacatacatatatatatattttcaggagagttattttattaaaataacaaaatttagaaatcagtaatttttttttttttttttttgagacagagtctcgctctgtcgcccaggctggagtgcagtggcgtaatctcagctcactgcaaccttcacctcccggttcaagcaattctcctgcctcagcctcctgagtagctgggattacaggtgcacaccaccaagcccagctaatttttttgtatttttggtagagatggggtttcaccatgctggtcaggctggtctcgaattcctgacctcgtgatccgcccaccttgacttcccaaagtgctgggattacaagcatgagccagataatttatttttaaatatcaaatttatagccagaaatttgggttttggtttgctgtgcttacctgtcctgaattatagtagaagcaaaataaaatattagcatgttttaacctatttatttgttctctcaaaataacatattttgaagaacatctatcaccctgctaactaatgcttaattattcattaataaaaattctttataacttgaactttgttgactaattattcggactacgaaactccaccaaatattctcattaatgtaactcatgttttggatgtaataaaaatagtgaattctgtaattatcccaggtgctattaacatttgttgaacatgcagagcaaggggactacagacttctgccaacacaaagacaagagaaatttgctttagcaaatttgccttctatttctttattcaatctgattgagtatggtagcaagacaaagactttttttctgtttctggtgaattaattgcattgttagtgtttcagaaccatatgaaacaatttccctttaaattaatataaacgagaaaatgtaccacagtctctttgtatcttttgttgtttctcctttagagcccaatgtttcatggcagtcgagtttctggaattataaaaagtataaaattattttaaaaacagtaaaaaagattgtgtatacaaaaataattcttctaaacccattaaaaatagaattacctttctctcagaactaataagcaaataaaactagctgagattacaatcactcgatgtaaaaattctaatcttacatgattcgaagacaaatatttttcccaaaggcataacaataagcatatccaaatgttctttccagcagagaagaatgaaataaagctacactctataaacttcagtgcacgatgtgtcaactcaaggattagtgtgtatttcagaaaataatattgaaattcgtgtttttattacttagaaaaattcacttctgtaagtcaaatttattcatatctttttatttgtttactaaacgctaaaagacttcacattaacatcatcacaaatatttagccaagaatgccagctgttgattatgggcctatgacagaggacttggcatatttccaatcagatgcttctactgtatcccaaacagagcattttaaaatacagtgcttctctgctaacggatgttaaattttcaaatgagcatatttgggagaatgcatctacgtattgacacaaaaccaccagacatgggcattgacatacagctgagaggcaaggacatctcctaatgatatggcactgccaaaagccagagaagatgggagtctcacacatacaaactctcatatattcatgtccagaacagtgatagctcgtatttctcagtatttgccctgtctagctaagtgatttatattgactagctcatttaatcctttgaggcaggaactattcttctcaccattttagagatgaaaaaactgatggcacagagatgtcacattatttgtccaagttcccaaagccattttaacttctaagcccacactttaaatcactatgctatgaagtgctatctcacacacactggaattcagacacagggaaaaaagatcccagtgagacaattgcagcatcagattaggcatatggtacttcgagagtgccttgtctagcatgaagtcagaaaacaagttgagtggcctttatcgctctgagtcttccgtcttttgtttaagcatcactgtgcccagagttggcatttatcatatggctacatttaactaaataaaaatatcatcctttttcaacatatgaaaatccccaaacttcaaagttgactccaaaatgtgcttgtttttaaaaattggcactcaagtatttagggataaaggctctttatgtcggcaacttattctcaaacaagtcagaaaaatcactcatacacacacacacacacacacacacacacacacacacacaaagaaaatctgataaaatattaatttgggaatctaaatgaaagtataggataattctttgtgctgtatttgtactttttctgtaaagtctaaaattaaaaagctgcctggagattcgaatagtcaaaaaaaatttattgagaaacagcaataggaaaattaaggatacaaatatatccagattggcatgtccaaaataaaacattactcatttttttccggcacatgtagaagactgcttaacaccccctatcttttttgcaatatagactagaagagaaattaagacctagattatgttttcctttctacctaaggcctctatttcggttctagctttctatttgtggggttttttccccttctaggtcacacaatctcctttctacaagactgagttgcatttgaaagttttaacagataaacaaattagaatgcaataaaatagccctaatatccacaaaagaaatataatagattcacctttctacattgaggctaaaattgaatttcaaggcattaggtgaattagtgtatagccaaaactatcctagaataacctttacatagcccatcaagtaggggatcattgttttgtatagtaatgattatgcacagtaaattttgacaaccgctaacctgaacaaaaggaacaaaataaaaacttacatgcaaatgtctaagcattcaaatgattttgcttttaagataattatcaaatcctcagcagtataaggtgaggaataggggggcagtgagaagaaaattttaagtgattttgcttgatgtaaactttattccatttggtttcatgttaacataatatatgtaagtagatttgtttgtcagggttaaataagagtacagagataaattttgcttccagccatgaggaaggaactcacatcatggtaggccttctgtcacaagccattgtaaaagaggacaaaatgtgtgaaatcactgcttttagacattcagcaaaagacaccacgtgactatgatccctgaaagaagggcaaaaacatgagatgagtcctgtaattgtaccagctttctgcctggtgtcacttcctaggctgtggttcagagatggtgcccaaaccaacacagcggtgccacatagcagaggagacagagattagaattcagggccagtgaggtgactggaatttgtattgcaggatcaagagagaagcgagctgagcagaggaggagttccaaaaatctgcatagaggtccctttgagtctttgaatagcaagctgtttatattcagattgaaactctctgaggcaggacaaagtataactattaggaagagaacaaacacaggagaactgtgagttgagctctcagagctagacagagtgtggagatatttgcattctgacttgccaaagtgaaagcaccttactaaacactgtaggtacaatattgctatagtttggagctttgtcccctccaaacctcatgttaaaatttgatcctcaatgttggaggtggggcctaatgggaagtgtttggatcgtgggggctgatctccactaaatagattaatgccttccctgggggcaaggtgagtgagttctaattctattagttccctgtgagagctgcttattaaaaagagcctggcacctccctcctctctctctctctcttgcttcctctctcaccgtgtgatatctgcacatgccagctccccttcaccttctgccattaatggaagcagcctgagactttcatcagatactaaatcttccagccagcagaattatgatccaaataaaccttttttctttacaaatacctagttcctagtattcatttataacaacacaaatgaactaagacaagcgacacaaatggactaagacaagtagaaactccacacaggccataccttagaagtagggctaatctagtcctacaagaaaggttattcttgacctaccttaacaacaagacttgaaagtatcaagctcatctacaggtaagttaactgcctatgggaaaaaaacttaacactcttattaaggaagatgatagaaatccagtcaacaatgaagtatccataatgtttaatgtataattttaaaatgaccagtcatgcaaagaagcaggaaaacatgatccattgccagaataatagtcagtcactcaacaagaacagacccagaaatgacacagataatgaaattaatagacttgtctttaaaataactactataaaaatattcaggaatttaaagagagaagacaacgaaaaatagaaaatctcaactgggaaacaaactataataagaaatactagagataaccagaaatttaaaattcaccaaataagcttatcagcagattaaatactgcagaaaaaactatcagtaaacttgaaaatagagcaatttggaaattacccaaactgaagcacagaaagaaaaaacagctgaaaaatagtaatggattatcagtaacttatggtagaattgcaagcagatttaagaagttaaacaatgcctaagcaggaataacacaaagaagaccataccagggcctattaattagggttccatcaggtaagtggaacgactataagtgatgtacagtcagggatttattttgaggattagaccttaggcaattgtagaagcttcttaagtggtctatataaggctatcaactctgtgctaacattaggcctgaagtcagcaaggaaatatagacattaattaagggggatccaagagtgaaccctgagggaacttgtgggggaaaagtgaaatctataaggcaaaactagaacccacgagaacaaataggaacatgtatttgtcccactccctccaatcttgataatgtaagtgaactgaaaacaaagctggcactcttccctgtgaaactatacatgacttggcctgggattcaaagatctaacaaagtatttctggttagaaaaactaagcccaggttttgctccccattaccagtgaggtaaaccagtagatcagtaacagtatgcatgagctacaatagtacctcaccccgtgccaaccttcacagtgttaaagaccagctgttacttcacttctaccttcccaatctcacacaagtttctgttgtgacccatcataaactggaatgatacagtgaaaggattcctgagaaacattccagtttagctatactgaactgttgccacagtccacccccttacaacttggcactcccatatacacctttcaacaatacttaacttctaaatgaagacaatagtaaaattatctttttacatagcacaatactgatatatactaaaatactgatatataactaaaaacatgctaaaactctctgaaaagatgatacaaaatccctttattcaattttggttaatgtttatttttcttctaatcgaatcacactccccctaagatatattataacttaaatactgaaatataagctcagttactattaatacttcctatgttatatgttagggagatggagggagggaaaagatagttggatggagaaaaaaatgtataaatatcttcatataaaaataagaaagaaattctcaaatattatggtgttcatttctgcagctggtgacatgatttcagttaatatttgttacttcagtcttctactacccactcctattccctttgtcttcagtaagcactttgcctggtcataattctttgcctaatggggtaaaacaagccttcatccctgaagtgagataaactgctaatggcccagccatttgcagttttgctgtagtttttctttgactcttatcacagagcatggaagtattaagatgtgtcccaagatattttgtgaattacaaacacattcctccttaccaccatagtgcagtcaaaacttaatttcctcttgatggtcaaaatcagtcattgcagtcagtataacctccccttctctgcccattgatttaccaccatgagaatccctaagtggtcatatgacagcgtcaaattttcatgtaatagaaccattgctatgtcccctggtggaagcattcctctcttgagaactaagacctctagacaagatgagccaaggttgcatagataagaagcaataattttgttagtaatggattaggggtaagcaaggagataagccattcactttcatttccacttcttgattcccagatctgtgtaatgagagaaaaacactacaaattggacacagattcagagcatatgctctattttggatgacattactcaagccctacaaagtgttgccatgcatctggcaccataatttagtcttcaaaaggccattctatcaggccagctgcttcagagtgatggagaacataataatacaagtgacgtccatgttcacaaggccattgctgcattttgttagctgtagaatgagtttcctggttagaagcaatgctgtgtggaatatcatgttggtgaatagggcattttataaatccacagagggtgattttggcagaagcattgtaggcagaaaaggcaaatgtatatctagaatgagtttccattgcaatgagaacaaagcattcccccttttatgttagaaataattaacctacttgctaccaagtcacaagctggtcctcctgggggctcagtatccatctcaggtagcaggttgggcactcagcagtggcagttgtcagatcagctttgatgagtggaagtgaacattgcttagcccatgcatagcttccttcgctgctgcccatgaccactttgtttatgagccaatcggacaaagatagatgtagctgcagaaacaagttcatttatatccatagaatggaccactatgcccacttattcatctgaagtggctctttggtgagccttgatatcggacacaaatatcttcatgatctatgcctgatgtgatctatgccaagattcacatacatctttccagacctcattatcaccaagtcaccagtcatgttccttttaattgagaatcattcagccaaactcttagccacaccgtttaaactagtggatatctgaccatatctcttcctccagataaaactttacccaaggattacaacaggcaaaaatatatttttttgtgttttaatcagtgctataaaaccaggaaataaaataaattaaaaacataaatgttggaaagaaaaaaagtatactgtctttattcaaacataacatggttgtgtatggtaaaaactataattatctaaaaaatatactactagagctcatacatgattttaacaatgccacagacataggttaacattaaaataaccattgaatttctatacactagcaaagaatgggaaaactaaataaaaaatccaatacaatttaaaatagtatcaatggacacaaaatacttggaaaacttaaataaaatatgtctaagatctgtatgctgagaataaaaaacattgctggaagaaattaaagaatatttaaataaatagaaatatataccattttcatggatttgaagactcaatatttttaagatgcattttttttttctaaattgatctgtagagtcaaagtattcccaaacaaaatcttaggtgtatttttattttggtagaaattgacaagatgtttttaacatgtatatgaaaagaccaaggctgggcacagtggctcatgccagtattcccagcactttgggaggctgaggcaggtggatcacctgaggtcaggagttcaagacaagcctggccaacatggcaaaaccccaactctactaaaagtacaaaaaaatattagccgggcatggtagcccgtgcctgtaatcccagctacttgggaggctgaggcaagagaatcgcttgaacctgggaggtggagattgcagtgagccaagatcatgccactgcgctccagcctgggtaacagagtgagactctatctcaaaaaaagaaagaaaagaaaagaccgactactcagaatagccaaaattatcttgaaatagaaaaatactttgtagtacttatatcacttgatttcaaaacttattaaaatcaagatggcatgatatgatgtaaagatagattaatagtttaacaaaaacgttagtgagtccagaaactgaaccacatttacccagtcacttgatcattttttaaatgagtcatcaacataagttaatagggggaagaaaagtctttttgacaaaaggttctgtaaaaaatgactacttataagaaaaaagttgcgcctcaaactctgcaccattcataaaaattaattcaagaaagatcatagtcctgaatgtaaaagataaaattctaaaacctcttgaagaaaacatagcagattatttttgcaaccctgtgagagacaatccgaggccctgaactgtgggtttccatgtctgtttttgcattgcccaattttagcaaaaattctgtcaaatttgtttaaccagaatctctcacccttcatatctgatcattgtcaatatttgaccaaattccttatctcccaccacctcccagatgatatctgattactctgccctgacttcagcaagaatcctgttaagctgatttaaccagaatcccttcttactcctcatgtttcctcttagtaattttccatccactgccccaacttgcttcttgtctataaatgctcacttgtctttgctggactttcagagtctggaagtccaagatcaagttgtgagcaggattggtttaggggctggacatggagaatgtgccagtacagtggtctctgatgtccctttttataaggacactaatcctgtttgatgagagcctgtcaccattatgacctcgcttaaccttaatttcttccttagaggtctcatctccaaacaaccacacaggggattagggcttcaacatatgaattttggggagatacaaacattttgtccatagcagtcataaaaatgtcagtttggattaactctaaaataaataatgcattgttttacttagtaagaaagaaccaatctctgattctcaaagcttgggttctcatcagcaaccgaggccattgagtcaaatagaaataattacacattcaagatgttatctaaatatgatacaaattgaatattagcgtaacctactgacagaagcttgccttgttaacagtacttacttacaaaaaaaaaatttgagtgtcttctatgcaatacccaatatattaggaactgttattaaatgaggtataatgatatgataacaacaagccatatggttacagacatacttcactagctgttctgcaggatgagcatgaacagtagcgttgtataaacaatttagcattgccaaaatgaagtagtgatttgaagtgattgtatggatatatcaaaataaaacttgctaaatggagtaagacaggttttagcatgaattaacgacataattatttcagcttatactttagctaccaagtcctggcataggtgtaataggatagagtgctaggaagcacaagcctctaaaagtgagaactcagatgttcaaacacagaaacccaacaagcctgaaaaatattgccctacgagaaattagaactccaaagagttgctttccaaagttaaaatttctgtggtacaacattttcattctcatgaaaatgataacttcttagaatggataccaaaaaatagcaactgggcacagctggatggctgcctggtctttagtgcaagagtcctgatgtttttcagacaagaggccagttgttattgagtttcagagagaaagaattatttagtgcaggtatactccttacccatttgtgtatatgcacgttttatgtatagctctgttctataactgagagcttatgacagagagtcataagtctcttgaagaagcaggaagaagaaatgataaaagggaagccaaggaaagccctgcctgacaaatagaacacctgtcaggtcaacgttccatgggatctaacagtacacactggtgcaggcccaattagctaggcaaatgatttaggtattaaagggacataagtcatgagaacagagtgttggtcaaagtcaagtttaaaaagtgagactttccttcactaatgaaatatttcctaataaatttcctaataaaatatttcctaatgaaaaaggtaaagggtattaagaatctttgtttttatttatttatgtattagagacagggtctcactctgtcacctaggctgcagtgtagtggtgcaatcacagctcactgcagcctcaaactcctgggctcaagcaatcttcctgcctcagtctcccaagtagctaggattacaggcacacattagcactcctggttaatttatttattaattttttttttttttttgcaagtacagggtctacttatgttgcccaggctggtcttaaactcctggcctcaagcaagcctcctgccttggccttcaaaagcactggaattacagccataagtcactacacccagtcaagaatcttttcaaactgatacccgttacaaggaattttaaccacttggactgccagtctgataaaacttctgtaacagcactagcatgtgaatttttgtttgttttttaaacagagctttagttacgtagatctgaaggaacgagatctgtagaaaagccatttgatccagcactcaaataacagttcttgacggaaagaatgaagttctaaactataattattagccaaaatgtcattatacattttaaaaatcccatctttccagacaaaatagttggaaaaaaagaaatgaatccaataaagcattgtctctaaaaaattcattggtactgctagcatgatttttaacataattcatttaagattttataataggtaaactggacataggaatgctgccatgtttataggccgctcaataggaaagatgaaactcatcaacaaaggcagacatattgcagccacctaaccttgtctgccacataatagtttccctataaagatttgttgatgcattgactgcttggtttaaaggccctaatagtacagcattaatttcttatgaagtactttctaatatcttgcatttaagttttaagtgtaacctttgctatattatgggactgactcttttattgcattaaaactaacggatgcatattgagtaattagctttgcctttctttctatactttctcttaaatctttataagggatagcacgggaactatatttttatctccaagtttgcctccaagtccagctgtgtagtgaaagggcagcaggaaacttcatgaagtatgccttcagctcagagtcagaacccgcattcagaactttgctggggatgagagaaaggtcaaacctgtgggttaaaagagaaagagagagagatgagaaatttacagatttttatgaagaaagctacaataatttgtgctctggacacagacggacttgggttagggtcctggctgtaccacttaacctacataggcttagtttctatattaataaagcagggctgatggtgaatataaagattttaaaggctctagaatatagcaggcactcaaaaaatgttacagttattattccaaagaacatttggtgacataaaaacatgaggataaatatcatccaggaaaaatggaagattctgcgtaggtgatagtccaaacaccattcagaaagccagtgcatgggcaaattgctttggagccacaaaaagctaggaattaatgacgtcttgggcttcaaggaaatagtggggagctgatctcccacaggtgtgggagcctatccaaactctctgttttcctccgtgtcctctgactgatgcccaaatccaacctggatgacttgtcacacctgtgacactagcacccacccaactctgatactcaccagtttagcaaggccctcttccatgttcaggtacctaaactccagaccccttgggacacactgacttatactttggggcactttgtcccactggaagaatatgggagtagggagaatagagaacaatggtaagagaagcttactctcccagcctcatcatctccggctttctctatcactgaaccctttcctcatagactctccaggtctcatgagcttgattaggcgactcatgaaaaattctcattactgaagcctgagatttctcctttgcctgccagtcaccctctgtctctccagagtcagaacgtttgcaatttccatctcaatgattattttaacaagtgaattaggtttgttgcccactctgtagatttaggaaggacccttatctatgagtgatttcggtctcacatcccaaaagtccacatttctacttcagcaggccacatcatgtttgttccatggttcagaatatctgaacttttagtttagaactggctggtggggacctggagttcatgcaggcagtctgctctggagtctgcgtccttattcccattctagtccacatccctctaactagagtggatggggaggggagaggaatggaacaaaaaaggtaggttaaagttggattgaatagaatcttgaaagctaaaccaaagaattagaatcttactatgtaggcagtcggaattcagagagattaaacaaagtggtttttgaggaatagtaattggttggcagaacacaggattgaatagaataaggaagatattaaaagattaagagactgtttagaaggtattacattaatctaggtttaacaagatgaaaactcagcctaggaggtaacattgggaactaaaaagaagtgatgggcatgagccagttaacatcagcatgacctggtgggtgattggagtggagagtaaaagcgataagtctggttttaagagtagatgatgaggagatctaattacatacacacacccataactaaggagttgtatctgataaattatttaatctgaacctaaatatttttattccttaatttaaacctcctcccttttttatcttcagcttaaacattgctgtttaaatcctccttaacactttacgcttaagactaaatgatcctgatattgttttttctcattcctccacttcttaaatacatatatatatatatgctaattaatgggcagagttggtatgcatgtactgtctatatctctataggtgaaagcaaaaaacggattctggagataaaaataagaatgatagctctcctttattgaacacttattatgtacctacttctgtgctgagctgctcatatgtattatctattgaatgcccataacaaccctaagaaatagataccattattgtcttcatttgcccaggaggaggctgaggcttggaggagtataagaacttgctgacagtcataacatctgaaggggattagaatatgtcacgccaaaatatgccactttggcataataattattttaagttgaaggcaattgagaaaaagcagacacaagaagagctcttttccctcccctatctgcctaaacatagggcataaagctttcttgtgaaagtatttccccaccttccatatcaggaaagggataacaaactgtaccactggaaatggagacagcacctaaataagtctgtatagacaaaccttactacataacctttatctagcagttaatttcccccatatatttaccttcccacaatttgccactcctagaaagccaagcccctttcttttgtgtagtcacttctccataatttatcactctttgttaaaatggtgtataaggccaagtctagtcacttctttgggctgtttccttctgtttcttcaaagcccatgtacatgtacaaagattaacatccagtaaattttgcatgcttttcttctgttaatctgtcttctattaatttaattcacaggccccaactacagaagataagagggcataggaaaagtttttcctctctacaagccaaaagtcgcaaggctaatatttactcccctgattctctcctccagagcccacacccttcatcactactgataaaggtatgataatgaattctaaattcctttcttaaaatctgctaattgggtaaagaagtaaagaaaagtttgatattctcctccatataatggcttatttatagctataacttacttgtcaaatacaaatgctaccgtggtactatttatgtgacacgtgatccaaagactgttaccacacactacactaaaacatggatatgacatatttcctgtgaagaagaatttggtatgatttagaaaatcttgaatcatattcaataacttaattttttatccaggatataaacatataattgtttcaaggtataaactcctgtacagaatgtcagtgtattatggcacaccccataaagagactgtaaaaaacaattatagttttatgctcaattaaagagacggaaatttttaaaaggggctatgtcaatcagaaagaaaagtacctagggctcattaatttaaagacagtaattgatacgctggcttcaggagtgtttttcatattatcattaatcaactcttcatttgaaaaacacacacgagggaattactgaaagagtaggtatcacatttaattttttccactatgtttttcctagtttcaaatatgtttttcaaatctggcattcatggttgctactgcactggaataatggtaacaacaggctgatgagaatcttaagtggcacttactcagtggagtaattggaagcggcaatggttatacaaatgaatgcccctcagagggaagaaggagagatttgccttgaaactgcggctgtaaaaagttagtgctggtaagtgaagaaacagaaactaagtgatagagaatgggaactaaggtagaaataactaacaaagatcactgtgcagaaccgtagtggtgttcagagtagatgcgcaagtccatatgcatgtagcaaatacaagtctcaacccacaaaataaagtgaagatgaatatattttaattttgttaataaagttattttaatttctgttataagctctcttccaccaagacagaagcacggtcacatgcctgggtaaaaagaatatcccagatacccaagactagacagcatgcaggggtgacaggcttattaacttcacactcactgggccatcagtactttacttataacctcattcatggttttgaagttttaaaaaaatgttgccaccttgttattttgttactcctctcttataagtgattttcagataagcagaaacacattaaagggaaagtttatttggttcatttgcaaggcagagtccatggatttcttttggctatccctttttgcactttcaatggaacaaacagtgcaatttttatcccttctgtttttagagcagcagctgtaaaagtaattaatggctaaagagactctagcacatcctactgaaaggccattctgggttcagcaggagctctggaccccaggctcctgcctctgcacgttcacagacttgcagagagcactctgatgaatgctgaaggacccccctcccaaacttgggatctccgcagcaccctgatccattttgaccactgccacttataaagaaaactggtgtcaacaggtgttttcatactatttccagtgatgactttggtgcatatccagtattcttttttttaatctctgggagttgacaatgttctcatgaattctattaaaaaatgagcatttcccctaatatgttttctcttcctttcagccttcactttcttctttttgtctctaccttccttaaaatagcattgtgcaaaaacatccctgaggttaaataataatcatgtataatgaggaagcgttctgtgtgtgccctctgcagagtcagaggcctgatgtgggactgaaaacacaagctggcctccaggcctggtgagggtcatgctccctgtgacctcgagtcaattgctcgacactttggattctcagttttctgatctttaaaataaggatgacagtacctacctgggctacttcacagtgtccttgagggatcatgaaagtgagtgtattttgtaaactgcagtgttccatagggacataaggaatgttggtcttattgattttgttagaacaagactcttcagaaacagtggtgagagagaggaatcagtccgggattcctcttttccatctcattgactcatctgataacactgagatagtggcttgctgctgcatattccctagcggactgagagaacacacatttgccaaatatggaggggaagatgagctttctgaacaccctcctattgtctgcactggagctaagccaggccacatcttcaggataatgatctgaggacggtcaggctcaattcattctgcctgagctttgctgctgccccttcaaactacttacgaaagtggtattaggttgtgatggctgctgccccacccttgggagaatgcccaggggatgtggactgccctaggcagccacaggaaactggaccagaaagtgcagagtcactgtgtgcccaggcgcctgcaggcagatctttctccaccacatacatttttagtgggccctctcacaaatgcctgatatttaacatttgagaaagtcagcaaaatgttttgttagtcttttattcaccattttaagaatataacgtttatccagttggtgtcggataaaatcgggaaagaaaaatatgactgcactatagactcagggcccaaaattattctgatgatggccaagtaaaaacattaaaagctgaaaaatataatagcatccaggatattactgaagattagttttaagcttaagtttttttccctcacttatccagatttgagtatgagaagatttaaagaattctataaaaactgtgaaaatgcatctgctaaattaataacagtatttatttcacaaaaatgtcctaagttttgtaatgcctctaaaacaattctcaaacttcttggtctcagtatccctttaaaattcatacattacttaggaccccaaagggcttttgttcatgtaaataatatcaatatgtatttattgtattaaaagttaaacctgagagtttttaaaaatttatttactaattcatttaaaattaacaaaaacaaacatactacctgttaacatcagtgcaatgatgtcgtcatattgatgccggatttcttgctccttagctcagctaggtctgggttcttgtctcatgaccaggaagaagtaggcacctgggcactcttagagtgagcaaggcaggaaattttattgagtgatgaaacagctttttcaggaaggggacggggatggtccccctatccaaaggcaggagagttctcaatataaccgagcccagggctttttaagggctcagaatagggagtgtgtgctgactggtttgtgagtatgcaaaaaaggtcaaagcaaagatgccactcaaaggtgggcacgacattgtagaaaatcaattaggaaagggtaggtatgtgtaaaatgggtgaagggtggagatcaatcagaggaaagcacaccaaacaggaaagcgggttctcaatctggttcgaggagttaacttgtagcttggctttcaggctttaaactgtctttggcttggacgtgggatttcgctggggacccgcccctacatgcttaggcatttggctgcctcctgctgctctcaatatttcatatagctatggaaaaactctactcataaggaaatgagagtgagaagggcaaatgacttcttagtgcttgcttgtcaagggcttgtttgacaatgtttgctctaaaatattttgatctccatgaaaaaagtgttaaagaaaatgaggaattacaattttattatcctaggatttttaaaagtctgtttcattgatcttaaaaagtatatttgtattgttcaaattgtgggctatgagtttgaatcctcatcctgtcatgtactggttgaatgaccttggacaagctatttaagttttctggacttcagtgtcctcacctgtaaaataaaaatgataattgtataccttccccttggggatgttgtgatgagcaaattacttaaccttatgtatgtcatggttgtctagagggaaaaaaacatatatataaaatattggatatgttctatatatgtgtgtgtgtgacagagatacacacacacaaacacacacacacacacacagagatttatgttaaggaattggcacacgttacggaggctggccagtccaaaatctgcagggcggactggcgcctggagacccagggaaaagccagtgttgcagctcaagtccaaaggtcatttgctggcagaattatctcttgctccagggaaggttaatcttttgttctgttaaggccttcaactgattgaataattatggagggcaatttattttgctcacagtccaccaatttaaatgttaatctcaaaaacaccctcaaagtaacaaccagaataatgtgattacatatatgggcaccatgatccagccaagttgatataagacattttcgttgaccaaaaaagccaaactctataaaatatttgaagatatttattctgagccaaatgtgaggaccatgatctgtgacacagcctcaggaattcctgagaatatgtgcccaaggtggttgggttacagcttgattgtatacactttagggagacagaaattacaggcaaaaacataatacatataagattcacattggttcggcctggaaaggcaggacatcgaggggggccggggagtgtgacttccaggtcataggtaaattcaaagatttcctgattggcaatttgttgaaagagttaggttatctaaagcaagcttgtccaacctgcagcctgcaggccacatgcagcccaggacagcttttaatgcggcccaatacaaatttatacacttaaaacattatgaaatttttttgtaattttttttttttaagctcatcagctatggttggtgttagtgtattttatgtgtggcccaagacaattcttccagtgtggcccagggaagccaaatgattggacactcctaatctaaagagttaaagtcagcagaaagaaatgcttggggttaagacaaggggggctatggaagtcaaggttcttgttatatagatgaagcctccaggtagcaagcttcaaagacagtgatcatggtaaatgtatcttatcagatcttaaaatgtgccaaactcttaattaaatcactcaaggatcaggaaaagacctggaaagggaaggggattctctacaaagtgtaaattcttcccacaagagatagctttgcagggccgtttcaaaatatgtcaaagaaatatattttggggtaaaatactttgatttctttcagggactgccatctgtcacgtgatgctatactagagtcaggttggaaattggtatcttattgctacaaagagtctgtttcctcagtcttaagatctctgttttaatgttaatgtgagtcgatggtgcctgaattccaaaggaaggagagtataacaaggcacattcaaacctccttcccatcatggtcagaactagttttttagatttctccgaaatccctttgactgagaggatggggtccattcagttagtaggttggggggctcagaattttatttttggtttacactttgaatggtgcccggcatatacaaactctaaacaaatgttatatattcttaatattgtattgaatatatattgtttttaggtgttgcatgaaaaaatcaagtaatacgcaaagcaaatttttatttttatggagaaaaaaaccataaaacccaggaaacaagtaataaaggttaacatggctttttatacttaataatacttcatattttgaattaatatataagaagattcagaaaaaccagtgggaaaaatatgtaactgttgatgaaaagagttaaactccgtacaatatttgaagagatttattctgagccaaatatgagtgacgatggcccatgacacagccctcaggaggtcctgagaacatgcatccaaggtggctggggtacagcttggttttatatattttaggaaggcatgtgacaccaatcaaatacatttaagaaatacattggtttggtccagaaaggtgggacaactcaaagtgggaggctttcaggctacaggtaaatttaaacattttctggttgacaattggttgagcttgtctaagacttgggatggatagaaatgaatgttcacgttaaaaataaaggattgcagagaccaagttttattgtgcagaggaagctctcagatagcagacttcagaaagaacaggttgtaaattgtttcttaccagacttaaaaggatgcctggctcttagctgattgtcttctggatctggaaagaaaggaaggaaaacaaaggggaaaagggattctctacagaatgtggttttttcccacaagggactttgcagggcaatttcaagatatggcaaggaaatatattttgtggttaaatattttttcctcatcttataatgttatgccagaatcagattgaaaagtcacaaaatatagggtcaaatgaaatccatctgatgagaacttatggtttgtagggcatgactccctagaccccttaggtaggaatttgggtaacataaaaaaatcagagcttagtcctcataacccagaaacaaatcttatcatatacagtgatatgataaaaattggcatcacaatgtgaaaggtgagttaatcattcagtaaacagtgtttaaacaattgttaattatttgtttaaaaaaattactttatatcatcactttaaccaaaaaataaattccaattctatttaagagtgaaatgctaaacatacacatacacacacacacacacacacacacacattacagaaaataatttataaatttatctatatctatatatagataaatatttagcttatctttgggtaggattttaactcagaaatcattggaaatattactaaaacattaaaacattgattacattaaaattaccagtgttaaaggtaacaaattgtgaaagaacatctacgcaaatgtaacacagaatcgttagtatatgtaaaatattgcaggcttacataaattgataggagcaatataagatcccactggggaaaaaaatggcaatggtatcatcctggtctgtcagtttcctttgagtcacaaggataatagaagtacagattctttaaagtaatggaaatttatgtagaattcctcagaatgcagagttagagagaaaatcatcccttaagtaacagtcatctgggaccccaatgtcatcttaactgggataaagtgttggcttcaaagacaattatgagaactgtcttgtttaggacaatctcttgtttgcctttcatttgtacttcataaaaactgaacatgattaaattgtttggtaataatagatggattgaagaaattgattcatgggaatacattttggactagatttgtcacacccacaaatgaaaaatggatattttctagactttcacttattttaattgatgcacaatggcttatttaaaatgtttcagccttaatcctccctctccctgctttttgtgagattttctggtctcaccaactacagttctttccaggtttggggatggaaaaagcgtggtaccttttcatcccatcataagggtcacagccaacactcctataacaaaaaacaggttaacatgagaaaagcataacacatttctttaatcaaagttttatatgacatgggaggcttcagaaatgaagacctaaagacccagggaaaactgtctatttttttgcttaggatcaatgaagaatggacagccatgtagaaatgtgattggaccaaaggttgtgatctaatggtgataggttgcaggggaaacccagcaaggcctgactgttcagattcttcttggcctctttgtgtggtatttctttctcctgggtatgcagcaggacccctctggaatgagggtcttatgacctgctttcaagcaaggtaggtcagatggcttccttgtggccagctcctacacagaaagtttagagcaatatttctagtttctatgacccaccttgggaaagaggaattctagtttctatggcctgccttggggaacaggaaaaagaaaggcaggagaaagtcagagacagactttgattctgagacccttccaatgtccttcggtttaaagcactcagcatgccaaagtgccatgctgaggtggttcagaaaacccccaacacaggactgtgagctcatggctggtggggacttactgtctatgtgagtctgtgcctcacacaagtgcatcacacccccatgcctcaacaccacatgtaaagacaactcccttgaaggattaattggcactttaaaaaggatgttggaacagagaaccaaattccggatactttctttcccctactatttccacaagaggcaccatgcaggttgactcttagccctggttgtcccaaaccagaatgaaaggtctggcttgactcatggagattagcttaggctgctgggcaaaagaaccaaaccctggtcctgactgttgcattggagccttctgtgtggtctagtggagaaaatacttgctgggagccagaaattgagatctgctccttgtccagtcttcagagcaggtggcggggccagctttgccagagtccaagtggggcacttatgtttgcagccttcagatttccctaaaaatagcaagacctctgcatccatgtatcttttggttgagtctcagtcacttgtaagcttcaacaattaaatttacctccctgaacctcaatgttctcatttataaaatggaagaactgcttacatcatgccccttaagaagattaaataacattgcactgcgcacatagagcatgtgtttggtgtataataatctcaagaaatgaacttctctcccccttaagcttatgtcaccatcttgtttcctaacagatccatttttgattaattttcagacaggaaaggatcatatatattcaaatggtgttttattagctaataaggcaaactaaatgttctctcccaagcatattggtattttaatatggaaaaatgggaaattatgctgtcatggtgatacctgaggcagcgaggagaagccaacaaggactgtatccagagattcaggagaaattatccaagaattctttgcttcatagcatttttgaatcaatcttttgatttaagccttctgaaacttaacttgccaatattttgaaaagtgaactatcaagattgttgtcaatcacaccctagtgtggtttaactttcagatccctttttggaagggaagttttatttaatccatgtgttgagaagaggaggatgcagttcatataacctggatatttagagtgaagggagaaagaagatacagtgaatatgaaatgaaactttcacataattcacacatgtacccagagttgcaaggagaaaacaaaagtattggtacataagtacttttacgtgaaatgatttaaaatgtttgtatatggtattttttgttgtagtttctgagatggagtcttgctctgtccctcaggctagagtgccgtgccacggtattttaatttatttttctttattttgaatttctctactcaaaggtacattttaaatacccttaatcatcatgatgatcccacacttcctgcagattcccatagaaagtcacacatcttcctcctgttgaactattgctccacaaatcatagtatttgcctaggattttgctttttaaagttccattgccacatttgtggtaaattctattgtgtatggtaacacatgataacaacaatgcgtagcgcctaaaagctctaatgaccagcaattctgtggtcagtaaaaggaaattacataacattagtagccaatatgctgttgagggaaaagtcctcacatttctcctgaccatccctgcccctgtcacttgccactaatagtaggttttgcaactaggtttgggggtgagtggaccctggagtactattctctgtacccccaaaccatgcccaacccttctacttggttatttcaactcagtggtggtcaagttttgttgtatttaactcctacacaacttcactctgtctgttctatcataaaccatgtgtgtctagtactatcaagctaagcattttcattattactttatttacataaaacccttttaaaagaataatttgacctaagatacaggtcatcctggactttccaccatgtatgtctgttagtggtggtttgtcttttttgggggggatattttgttttttgtttgttttgttttcaattttttgagtatttactatttaaataaaaagcaatggcagcaaaggtttctatttccatgtccctttgagctttttccttgacatccacttctctcacaaggatctggccttcatgccaagtctctgctgatcttcactgcggagggcagctcctcccaggagagggtccagcccctccattggctggtgccggcctcacatttgtcctgaccctgtgtctggcttgtgctgcccgtgattatggctcctgccggccgctcagtggcccatgggattgtggagcagaaagcagaaaaggaattttggattacgggggggaaatgatgctttaaaaaggcaacagttttctgatgtctatttttttttcattctaagatagtttcataaatttcctcttcatttcaaccaagtacgcttggttacacttcctaaggaattttgttcaactagatggtatgttttggtgaattaatccaagaggacgctactgaaaaaatattatatatatgcagctttcttcacagaacatataacaggatatatatttgggatgttaatttaaaaaacaattttaaggttaaggaatgatatagtgtgctagattaagatgtattgagcaagtcatgctttactttttgttcattttactaggtcatttaaattccttttatgtgctcctcagggcagttaactctttacatgtttgattcagtgctggaaaggctataggtattgaaaggctctaaaaagttaagtgattaaataattatgctcattatctttatcatatttgatgttttaaatactgctaataattcatcttactttatttgcactaaaaagctattcttggatttaatatttctagtaataaaaaaagcaaaacagatattctctcatttgtgttcctcaaagttaattctttattatcttccttctcctcaaacatgaagttttatcaacggtgatgcattttcttgtgtgtttcttactctatcagacttgatccagtcagactcacacacctgagatgaaacccaggctcctggaagctatgaaattgttcagtaatgtagccttataagtaagcaattaaagcaggcctggagtccagtaaggcctatgccattcatactggcaacaggcgatgtattttccatcactctttccccttgcccagatagcttctctcaaaatagatggtatgttttattctatcaagcatttatattaccttttccttcctagccattttaatggaaatgggtggagaataaacagtaactcaataagaagtcataattgctcattgtagtacatcattgattgtgtgattttgtaatataattgttattgggctcttattgactggattctgggtttctcctgtccttgttaggttttgtgttgactattttctctttctatttttttcctaagacttttaaagtgtttctcaaattatggtctttgttaaactttctgcatcccgtaatgtggatgttcaaaagattcctggtccccactccctacccactgccaacagaatcagattctctggaagtgcgagctagaaaaatacattttgaataagtactcctcccctccttaggtgcttcttatgcatgctgaagttataaaaccattgaggaaaatagacccaccagcatcatctgaaacacaattatccttccaattgtgtttttttccccctacactttctccttttttttaatctatcatctcttccattttcaagacgatttgtgagtcaatgtaaatctgtattgctgggccctatccaccaaatctacatccagccttagacattaccaatatcaggaatcatctatggaaagattcaggcttattccatagccataaatcctggaaactgtccttagtcatttagcacagtcttagaggaggcctcggcattctgtggctagtattacaccatcctttagcatcatgaatgtcaaagttgtgctgagatgaagtgaaatgtacctgaaataacaaaaataaacaaaccaaaactacttcctacttgttgagtttctcctacttccaaaattactctgtttccaaaagttccaggtcctacaagtgctctagattctatcctatgcctctttcccatgaggcttttggacatcttcaggctgtagttctttttcctactcccctacccttagaacatagtaagtagttaaatatgttcttgttattatgctcattctcattgtgttatttatacatggcaaacacaacggtgtcttgcacatgtggtctataatctataaattttatttatcattataaataatcttcaaaactatattcaagtaacatcttgggtaacagagcatatcacagataaactgtgaaagcccaacacctatttaactgatttatcaacatgctggtggatacttaaaggatttggagtttactacatattaaagtgtatgttatgttattatcaactcaaactaattaataaaattagccaggtgtggtggctcatacctgcaatcctagcaacttgggaagctgaggcaggaggatcacttgaggccaggagttcaagaccagcctgggcaacatagcaagaccgtgcctgttaaaaagtaaaaaataaaataattagccagatgcggtggcatgcttctgtaatctcagatattcaagaggctgagatatgaggattgcttgagcccagaagtccgaggcagcaataagccaggatcgtgccactgcactccagcctgggcagcagagttagacccagatccttaaaataaactaatagaattttcatcaacctagttcttcctattctggcatgaccagttcagaagtttctgtcctactttagtgtgtaatcatattatttaaaaataccataatttttaaaggtgggtgtttggtaactctgacatttagtggaaaaagatcaaaacaaatccttccttcgattctgggcaactaatgtccacccatcctatgacttttatccagtctggcccatctgcatacttggctagcttttctggtctcagcacgggtaacttctctgttgagaaactttcctcatccagcaaaatctaggtttggggaagctcccacaggctctcacagcattctgcctcctcacaacaccaatgacatttgtcactgcctcctgggcagtctctgaatctaaagtgtttcatattataacttcagtaccaagacaagagcctggaacacaggtggatgccttgatcagtaaattaatgcaacctgtacatgtgaaaccaaaccctgtatactttagcatcatttatggcacagagagccctcttcgctttactctgattaagtggccattcattctccttttgtttggctcctgctcttttgttatggcccccagtttctgcatccattctgcaccatgaatgtatcagttaatttcagtaatcctggtcccatcttctggagctctcaggggactctggttcaggctcaacactctagagattcccagttttcacagctttagaacaatcccctgctccagcctcttaagccaaaccctgagggccccttaagagagaggaccaaacactctatgtccttatgggtgttttcaatctagcattctaacctccttgaaatcataaaaacacattttttttctttgattcattttatctaagtgtcttggacatttccataaatggatctgttgacaataactatgaacatgttttcactgaaactatctcactgatgagtatttggtggctttagaaagagaaatggttgaatattagcatggggtattaaaacctgaaggttaaatggatgaagaggacttgaatgaccttactgaggcaacaccgtgtgaaaaaaaactcttaacattttttaaagtcttctatttggtaggtccacagaaaggcattcatcacccagaactggcctttggaaggacacagacttatatttccatattttcaatcacaggtcaacaaagtttccagactttccaaaggtgaaaaactgtaccttaggcttgttgagtagttagagcagaaggaacaagtttgtcatttgactggtcagtaaacctgtttggtgtctggccagaccaaaaatattttttgaaggggagttctctttgccatgttattcttagttttggcccaaattgtcttttatattttgttggcatcaaggtgggctgccaaggagaagaccccagactctgagcagaccgctaggcagaagcaattggaagaacacaatgagcccttgatctgaaagaactgacagaagaattcagggagtgacaagagctgcttctatccaggagggctagtctgaatgcaacgattaagccatcctggggcacagtgcagggcgcttggtattgattcaatacatttttaaaaaaataagtgaatggggccaggtgtggtggctcacacctgtaatcccagcactttgggaggccgaggcaggtggatcacaaggtcaggaaatcgagatcatcctggccaatatggggaaaccccgtttctattaaaatacaaaaattagccgacatggtggtgggcgcctgtagtcccagctactccagagcctgatgcaggggaatcacttgaacctgggaggcggagtttgcagtgagccgagatcgtgccactgcactgcagcctggtgacagagcaagactccatctaaaagtaaataaataaataaataaataaataaataaataaataaatatgtgaatgaatgagaaattttatttatgttaaatttttgaccagagcatatggctctattactgagccagtcggaaatggctcagaatccagcagtcagcaacatcatactattcagggtcttcaaatacaccctccagtttgaccaacaattccaggaagtgaccagcaaagtctgcctttatccccttccattaagcacgtcaaggccagttttgtgaagcagttgattacaatccccaacctcaagcaaccagtggagaaacctgcagctgaatcccttgacaccactgaatatgaactaaggtgttgggcctggccttgtctgtcttacccttgaaaatgtacccaagagacaatttggttgggactgctgctatttgggagacctgattccaccctgggtagattttttttttagacggagtctccctctgtcgcccaggctggagtgcagtggcacgatcttggctcactgtaagctccgcctcccaggttcacgccattctcctgcctcagcctcccaagtagcttggactacaggtgcccgccaccacgcctggctaattttttgtatttttagtagagacggggttttgccgtgttagccaggatggtctggatctcctgacctcgtgatctgcccgcctcggcctcccaaagtgctgggattgcaggtgtgagccaccgcgcctggccaattttttttaagtgaaattaaaggcccctgacttcaggatgggagtcttctcttcttactgatgggccagcgttctcagtgcactgtctttgtggcaccatggctacagatttgctctgggctctttgtgctaataaaggcgaagggctagaaaagatggaccttgtaacatcttaaaggctctaagagacaattctgcatagggtaagaaaaaggaaattggacagctagacctatggttcttactccattcttaaagtggacttgttccttggataccagggaatacaacattgacatagtatagtccaatggctaaaagtgacctttctgaggagcatgatgcattcaggatacttctgctttgtgttaatgtttcttcccttctaatctattatttccaagctcgcagatcaatgaatagctttactatttaagattccagttgaagggggggaaggcaggaatgtaaatttgtagggaggagggaagagcaatcagccactctaaggtcccatgggagctggcaagcactggaccacagaatggaatgggatgtgctgaatgaagctctgtctgtcttgtacacaccagtcactccaaggagggagccaggaagcaggcggcagggtatgtgggctgtcagagtagattctgctgagaagacatgtgtaagggagaactattgctttaccagaagcgttgacaagaaatagaagctgagatgtcattgcaaaatagaatgcacccagagtagcatttgaatgtgaatgcaatcattggagaacctacggagaggccaggacaaaggagggaatgtgtgaagcttgtttgagagttgcgagtgagaaaaagttgtttgctgcgatgagttgacaaaaggaggatttttaaaaaacaactactactctttccaagggtgaccagtaactatcttagagaggcaaattttatgaaccaggccatgacgggaactgaagaaaatgcctgccaaagtcaaatgtctaaagtaaatatacttttcataaagaaagtacatagtatttgtgcattttataaaatatattttataaagaaaatgtaaagtacataatatgtgcatgtgtgtatttctttaaagacttatttatagaactagcaatcttagacttttttggtcaaactctttggtcatattagactatttaaaatacaaaaagaaataggcatattggtgtatatacaattttctagcattgcttctctaagtattctgtttctctgtcagtctctctctctctctcacacacacatacacaaacacacacacacacacaccatgcacaactattagcagaactgttgttttgcaaaagtttgatggtttttacttcttggaattgggtcctaccagtttgtctattgcccttctgggaaatgtgtccacctgtcatggatgaaaatattgcaaatgtgtcttctgtgttaccgaaagacctaagggggtgaattctattttgtaaccaagaaaagactagagccagttcttaaatgcttcttctagaattcaaataaaaacttagaacatatctactggccatgttgttctaattaaaatatgtcaatattaatgccaactattaccgtgggtacccacacagaagaaagtcaccaaaaaatgtgtgcagtttccatataaaggctgtttttatcactattttaatttaaaatggaatatggagaaatgcatgaaaataaaatgctgtttctaccttcagtatttatacttatcactcttggtactttttctagaaaccctttataggactcttgtgttttcctttccatcactctcctcactcctccagggcacccttttcttctgaaggccaacttgtggaaaccccaggagctagctaccatgttacaggaggctgaccatcatctggactctctcttatgtcagactgtggaatgtaaattttggaagtgccaggagctatagtttctatcatgtatacaaaacttctctgaagtgagaaagactgcaattgacataccaagaagagcacagacaggacacaaaggtatagtcttgtcagtgttcaagctcctggtcccacttatttctctgaattactacccatcctgggatttaattgtcctagagttctttgggttgcatgagccaacaaatgcccacttgtcctaagcaagtattgcttgggttttccatcatttcatcttctattctattcagaagattcagaagatttaacaaagtcctaggtatgaataaggaaataaatcttaggacagattatttccaggagcagtaattagaaatattaagctgtagccagacatgtccatggcatgatgtatagttaggatatgtaccattgaccacaacacaggtatggtggttttaaaaaatatgttgcaaattctttgacactgattctcttttcattaggtcagatctaattccttctccttttgactatggacttgacttagtgacttgtttctaacaaataaaatatgagagaagtgatgttatataacttttgagactaggtcttagatagtttcaactggctttctttctcatggatcacttgttcttggagaagttaacctccaggtcatgcagacaggcaaagaacctggagagaggcctatgtggagagaaaccgaggtcaccttcaacagccaacaccaacttgccagctatgtaagtgagccatcttgaaatggatcccccagtcccagttaaaccttgagatgattggtcaacatcttgaatgcaatcttatgagagaccatgagccagagctacccagccaagccactcttgaattcctaacccacagagataataaaatgtttacatttttaagctactaaatgtacgggaaatttgttgtataataagataactaatactatgtccaagattaagggaaattactttgaagaggttcgtcaattagcatcagtcataagtgacggcaggagatcccaaataggcaactcagtcataaaaataattggagttcatgattacaggtttggtccccaggaaatagagctccaggtagaaaacattgttaatgaagaacacatgggaatagaatcacttaatcatataaaaagagtgatagaataatataatggctaagataaagagtttgagagttaaacagatttagattcggatcttggctccactagtttctgtttgaacttattacttgtctgtattttttagttttattttgggatagttttaggcttactaaaatgttacaaaaattatcaaaagagtacctatgtactcgtcacccagcttccccaaatgcataagaatttcgcataagaaaaaacaaaacaaaacaaacaataacaaaaacataagaggcctggtaccaagtcccacgagtgactgaaatctcaatttgtattcatagaaagtctattcataccaccttatcctgttccctttttcttggtcctactttttccaggacacctgggttgtcctcttctcccttctgtgccaaactgtcctttcccattgaaaattaatgtattcaggctcacttctctctttaaaagatgcagtcaggagctaagaagccagcctgaagtttctcaacctccgtttcttaacactttagcaaaaacatttccaaaatgaatgaccctcctccatcatgccccacaccaagaaaatgtgagaaatggatcataaatttctcagaaaaatgataattcaagaaatttcaaaatataacaaactaccaatatatgtatcatttaaagaaaacattctttttgctctcacatcataaagtaatttgtcttcaaaacttgaatttgagaactattcagggcataaaaatgaagacatcagagtcacatcatatgtatgtgctggttgcctacccgccttcccatcttgaaggtaagcttcttgcaggcagagccagcatcctgagttctctgtcctgtctctaacacagtgcctgtcacacagaaggcatgttgattgactttgatatgatagagaaatttcctcttaagtattccatttttcagaattcattcaaaagtcaaatacccattctttaagacatcttgctaagaaaggaaaaattcattataaagggtcattttgaacattcagaaggaagacctaagtgttgagtaagtgaacagacctttctgctgatgtacttacagagacagaggtccgggccagttccccatcaccccttacccgcaatgttacaggctcttctcagagctttctccatctgggctctttctcggtagcttgttttcacatgtggctgcaagactgaacacagttaatctggtttccctgccttgctgcacagaaggccagtcaacagctctcttttgacttatctttaaacatttttttaaatgttcattattgaggagaaataaaaaggaagcaacagaggcacaaacagagtgaaacgataaggcctaggaaatcttacattgtacttttaatcatggaccacattctttgtttacccaacttgcctttgagaaggagtgtcgcaccctgtgctgggcatctgatcctgcactgctctgtgctctactgggtttatttccacataggttcacatggccttggggcgccatcatggagggtcttgttctcagtggacatggcacaaggcagtatcctcacatagtaaaggttcaatcaatagttgttgagttagtaaatgaatgactcatatggctaattttttaccgatctgatgggtggatgcaatccaacattgccaaagtgaagggttacacagtgggaaggccgtgggggtggatgtatttggcaggcggcagagagaggtacaggacgatcccttacattgtaaatgcaaaacattctcagtggaatttggctttcccacatagtaattatgtgtcatagtgtatacatgctctatagcttatttctcaaaacatatttgtgggtatgtttttgccaatgctattttcataagacatgtctcacagaaatggccaggagcagccagaagcaaaacccaccaagtcctgtttcgttcttgttctttctttgctaatatgtgcaagacttaagataactgaactcatacttttcctacctagaatagaattatcttataaattcttctgttagtctacaagtaatctgccttgatcctatggaattacaagccagtagagctgctgtattttgcttgagtgtggttaccacttggttggcacacactaaggatatttttgactctctctttgctgacatgagctacagagcctggttgagaaaaccctctgaatgaaaacaaacaaaaacctaccagaacaaattagggacaggggaacttggaagccgtgtaagagttgtgaaaccatcagaacattaggatttagggtgtccctttaaagtgttttagactttctgggaatactccctgggaaatgttgtgttttcacaaaaaagttgttctgtgcctgacagcacgaagaagcacgtgaagactggagactgtgagaatgttttcagcaagagccaatctggtagcaaaaggctaaaaattgcattttcacagctccgccagaatatgcaaaaatttcttgtccctatctattttatgacattaaaaatgatttaaggcaattgacacttctatttcttccaaggggaaaaaatagattttgtagagttctggcatatatcagtgcatgattgtttcagatcattgtagctggaatgggctgttgtaccaaagcttatctaatatactttgttcattcattcaaaaaatctttactgaatgcctgttaagtggcagacactgatctcttactgggtatatagaattcaagaggagagccatggtcaacttaatcaagaagcagttctaaatttttatcaagcaaccatagtgaagagacatgataaagtcaacccagttctaaccccaccactaaagattaagaaggaaatattttagtatatgagttaggtaacctggttattagtcatttagggtatgaaataggacttggaaaaggttattaagattttgaagtaatagactgaaacaatcagacttgggaaagaacacagatctcatttttctggattagctgcatttggttgcttgcgaggtgaagctttagaggaaaaggaaaaaggaaaagcattttggcaatcaggttacatgaatagcaggtttcagcagatctaagtagtcccaggcaggctgggccagaatgtccttagataatcaagtgcggctttactggtatggttattatcccaaaggagacctactagaacaggctcaactctgctgctgtacagcatgacctttggtgctttctcttttttatttctcctgtaggaggcaagagctacagcttaatggataagagcccatgctttgtggccagccatgcctgggtttgggtcctgctctgctacttaccagacagccctgtgatttgagtttcacagcctctctaagcctctgattcctgcctcataaaaagggcatggtgatcgtgtgatacttcatagagcgaaatgagcttagactaagcacttagcccagagcctgacacaaggcaaggatctaattctttctagctagtatctcttgcaaggacatcaaggccatttcttgttaatcaaagtgagccagctggcatcacgggttggaaatcccttagcaactggttagcactcagtacaaactcgcttaaaattggtatattggcagttaggaagttaccactaattctgtcacacttaaccatttcataatggtgatctatttagagcagtgattggaaaacaagaactttaaatttggtaaagaagctttatgttgctttatttgtttcagaaaaggacaatacctgagtcatgttctaagaaaaacatgagcatttttgaaagtaccctatgtggactgaatagtgaaaaaggaaaggcacgtggaaaaggacattattattttaaaatgctttgaaatcacattcaaagtcgtcagctaagtttcgtggtgttctggccactgagggactgccaggctctgtcttccttttttgcccatagagaccccagccctgcagtactggtagtgaggctcatggtagctcccactcactggactcattctgtcattttcaaaagatgttcagttcttaaaataaactgacaataaataacagatcaagtatcttatgatctaaaataattcaatggaaatttggaatgaacataaaactatatagatccccatcttccctggctgattctctcagattataaacatattaaacttatccccagcctaaagtagcctgcttgggagttggcagtctctcaagctgcccttgccccctctgctctcctccacagccaagagtacataagaagtagtcctccctgactctatccatttcctccactcccattcactgctcaacctcctgcagttcccgctactcccttaaaattgctctctacccagctagaggagagctggcagctcagaacttaccataggcttaaaggagaaaaacttgatccagccccaggagagctctacactatcctgggctgatatcaaaggaacgcaactttccaaccccatcagtgttcacccactaccaacccctgctctccaaggcaggaagcaggtgagctgagacaagggatgagatggaagcagtcatcataaaggaaaaaaaaaaaaagtgacaactctggaagtcacaaagttaccagtctcaagaggaaatattgattatcttttataaaaattagcgttcattctccaagaacccatttgtatttggaacaatctgaatctcaattatctgagttccttaaagctacaatgatcatattcacttaatttccataaatagatacacttgtttgctttacaatagcacctaggttttcattagagaaatttcgaggaagcacccctctgtctttaattggcttcctaattacactaattttatttgattgatatattaggctctggaggaaagggaaaagaggggaagagaggtcacaatacagtcctttattctcagctccagacagcacaggaaatcctcaattaaactataccacttccctcagcatgccataaaacccatgcattatatttaatatctttaagctcatttataataatggttttatgtgatgtggtgaagttaactcattccttctagactttcttttcattattattgcagaacaaggcatgcttcttgtgaaaaaaaaatcagaagttcagaagaataagtcctgaaaaattaaagtcccccgtccccccgccccgtcctccttaggttttctttagaaaacttccctgtgacaatttccctccatttggagaggcagacaagaggacatctcctcactcacagccaggacactgtgcatctcatatcgtgctgggactttttcttgacaggattgagggagattcaaagttccccaaaaccagagaggaacaaatgcatcaacacagcatctcagaccctggagaaagtccagccgtggccatggttttgctgtagaatgttttcttctaatgcaaagtctgacttagaacaatgtcttccttgtgccttccctttaaggaagggttggctggaccccgacaattagtaacttaggacaaagccttctgagttggtggccccataagggccagaaggaagtggttttcctacaacctctgttcctcagcccggcctgggccacagcacaggtgaaggttattggaggaagagttgtttcatctgggaggcttttccttcccttattatccacacctgagcagcacacaacctagaggctcaggtggatcatagttgtgggatgcctgtttattttgtggtgagcatctgagaagcgtcatccccacctccagagactgctcagctccccatgaaggggtgggccagttctgtctagttcctccactctcttccctgcatggtatctaggagtggcacttccccctgaactaggaatatctgaccctctgtgtctccctgtgaagcccgttgaggtgagtattaatgtctctgatctgaccgagcagcgccgggtttgcaagctcagctcccaaacagctttaagcttgttcccatccaggcagagaaagggagatgttagagaggcttgggaccaaaaatggagaaagaaggcagaggttcagggcaaaactctatccagaagtgctgtttatttagctgagtattttctctctcagaatgatagatgactattggcggggggcgggggagtggtgggcaggatccctgacaaatataccctcttcatatgccgccgaaacattcttggagattgtgctctaggaatccccctgattctgtgattttccacgtttccgtgactgcttgagggtagaattagaacaaatggctaacaggataccattccttacagctcaataatgctgattgtctctggattctgagtaagaaggaaactgggaaacatcagtatctaagtacctctagtgattgggacagaaatttagacgtctggcaaactttctttttctatttcttttttttttttttttttttttgagacggagtctcgatctgtcgcgcaggctggagtgcagtggcgcgatctcggctcactgcaagctccgcctcccgggttcacgccattctcctgcctcagcctcctgaggcaaactttttatttaaccttctcaaagaaaatttaattaattttaatgactttttagcctctgaaaattatttgcttacaaaattagcttaataataatgattacattgataaagatattattttagcactaaatctgaggggagaaaattaccgtgagtttcaaaatatattatttttgactacttcaaaagatgtttgaagtgttaaaattatttttacagtttctcttacacccagaatattgtattgtcttagtccatttgtactgggacaaaatatatagcaaaatacctgagactgggtaatttgtaaagaacagaaataaattttctcatggttctggagtctgggaagtccaaggttaaggcaccagcaggtttgggtgccttgtgagggctgttctctgcttccaagatgacaccttgtggctgcctcctccagagggaagtgacactaaggtagaagagcaagctcctcaaatgctgtgtgaagccttttttatgaaggcacctgatcccgtttaggcagaaaaagtacccctggtctaaccaccacttaaaggtctcacctcttaaaccatcacattggctacacctgaattttggagaggatgcattcaaattgtagccctgatctgtaggaatcagattattgatatcatgtctaagcggcccattgaaaaagtggtagacatttatctttcttgtgctctttcgtagtctaagtgcacgttgtacataatgaatactcaataaataatgaccagacctcttagacctgatttattagtgatttaaacttcataatttgcttttgtgtttagagaagaaagagaggaaaagttatgctgtttggagaaagcagcacttgagcttaaattctagctctaactcaagtgattttggacaggttagtaaactctctgggactgtatctgcttatcaataaaaggcagataatgatcctactatctcatagagttattatgaggactatgatcacacatgaaaacaccagcacaggacatgttcttagtgtgtacaaaatgccattcccttccttgcccctttacatggtacaattgacctgacatctacaggtattaa

SEQ ID NO: 2000 - DNA, 544426 bp, Homo sapiens
ccctcactttgagatatgatgtcactaacctttattgatccactatcagagaactttgcttatctctctcctgtgatatactgcccctcctgtgctcaactagtgtttaatacactgccgggtgccttgcactcctcatcgctcagcactgcagagagaggctgccacggggaccatatttcacagagccgggccttcccagcacagacgcctcccagagtcaaggggagccagcacccacctcccacctcctcccaggccgccaggtcccagctgcaccgagacagtgggtcgggtcagggcagggcaggataggacacggcccctccgggaccctgcggcttctcctttttttgggggagtgtggggacagagcttcagtcccaagattccccttttttccaccatgaagacaactgtcagccatgttcatgtgggaaaacataagcacctccgagtcagacctcctatttagagaaatgagcttcctgtttttccccttccaaggtctcaagacctcagtccaccgggaggtggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctgccacacaccgggtttggggttggtcgctcctcctgccaacccacaggctaaggatgcatcaggcacagccttggccacacccaagggtggggagagccccaaagcaccaacagacaggggacgattgttagaactcaagacacagaattccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagcaggggccctcccacagccccggggcacccaaaatttgcctaattgaacattaacaagttgctacaataaagttcctctgttgtgagcagggaaaccttttcggcaacaacaacagaagtcttgttacaaactgctctgaaagccaggcttcagcctcgacaggtgtgaacaagatttcaacacctcctacaatacaatgcaatccaaacaaaggggaaagtcaatcccagcctcctgaggtttctgcttgtctaacatcttcttcactcactcagcccaggggagccaagtgcaccttcctcaagcccagcagcagagaagacctcaccaaaggtagaccctctccactgcctcaacatggggccatcttggctgcccaggggcagttcggaaagtctctgctaggaacaggagtcctttcaatggctcccacctgctcctgggaccccaaggccccttctatcacctcccaaatgcagctagcatcgatgaaccacactggcgtgtttcccacatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggcaaaggaaaggctattcacaaattttttaaaagtggaagacagccataaaatatgccaggataatccccaagaccggctactctcaactttctctacctccaatcttggagcccacccaagggcaagagtggcctggagactcgctataaaatgtatgtgaccaccacaatggaattgctttgccagacatttttactaatgaatctcatagcacggagacagatcccatataaggagttaagcaggttcattctcctccacgctgccccttcacctaccagataagcaaggcaagtgcccccagttccatggaaggagagcagaccacaaaaaggttagaaggctcaagtcctctttccaggtagctgggaggatgtaattggtgaggcaggagattagaaatatcggcagcctctaagtaagactttaatttactggcagatcaatagagccggggttatattggcaaagtgtctacagctctattgactcacgcaatgcctcttatcaatttatcagaaatctggaagtcagaagatattgtttgaagggaaaagagaaaaaaaaaaagaagaagaaacaggaagcatgagtccagagctagagcagttagaaactagggtccccaatgaccaacttgctaccaagagtttcgtaccaatgtgtctcctgcaaagaaggctaatatgatacatttggagttaacctgcctcccttgcacgcccctctcagccttctcagggattccattttccataaaccttgtaccctggggagggggtgaatcctactgaagctggtctgggatttttgttttgtgttgtgtcttagcaaggagcaattccttccttaggttcagccatactcgtccaagttacagaagatccacacttctccaccccttgtgtggtttcctgctacctctccattctactgcagccagaattcctagccttggcttctttcttaccaatccataaaaagatttctttttaggtaaataggatatttatctcagcatcccaatactcccaagaggtcacaaggatctatcagactaacaatggcacttggtctcaagaagcgtaaagaaaacgaactcaagttctataaatcatcacaaatgttttcacaaataattaatcttcgtttgaaaatgttttgaaatatcccaggtagccgaccaaaaaagcctggcggcggggggggaagtaaacattcacacttcaccaaacccaaatgttcacaccagcgaaggaaggaaggacgcaggaaaacacgaagttcccgagtgtttctagccagtaactctagggggcaggtcggggaagaaagagagggtttggagcattccaggtatcaggaggccaaagggaaaagcgattttccttggtttggaggaaccacaacctgcttttgatgatccattttggtccctgcctcatacaacaaatttctgcttaattgctgttttgcatttcgtggagacatcgagtaaacagtacttaagtgtttccagacaaaaacaataactcactaatgactaaggcactgctaattaaaatgcccccatgatggcgtgactggactcagagccaccacagcaaacagaacgagctgggccttgaatgcatgaaccagaacgcgggcgtgcagggcggaagatcctctgctcctttctctgcaggtcaccacgggccctctggctgaaaagaaggcccactgtgacccttgctagaaggagagggcagaggtgtggagagaatgggaggagttagagtggggaaggggggtgaaggcactgagatttcagagggaaggcagcaccccaatagaatgcacattctagaaccttataagagtaagtggcctggcattgcctcaaaactttatgagctcctgagagcccctaaagaaaaaaaaaatgtgtcctactctagtagggagaaaataagaagatgtgttaaaactggccaaataggctgggcgcagtggctcacgcctgtaattgcagcactttgggatgccgaggagacagggagatcctgtctctacaaaaaattaaaaaattagccagacgtggtgatgcatgcctacagtccgagctactcgggttgcgggactgaggtgggaggatcgcttgagcccaggagatggaggttgtagtgaaccatgattgtatcactacactccagcctgggcgactgaacaagaccctgtctcaaaaaacacaaacaaaagcaaaacaaaaaaacaaaaacaaaaacctggctaaagaccctttcctagtgaccacagtcatacaaggcatccattcctaactacccttttaaaaagaagattcagaaagaacaaaaaaaccagaggtatactcgaccacctgcccagtgctaaaggatttctcaacgccatagtcagacttcacgagcgcatgcgacaaagtaacaggaacctagaaaacttctcttcgtccccaaaaagagaccaaaataactagccttccccagagcgggcagctttcctcttcagtgctcttcaactttcagtcctacagatgggggcctcccaacatcactttttaaagctcagcatttaaaaaaagaacaggaaaaaaaaaaagtagagacatcccagagtccacacgcttgcaaaggactttcttttcctcctcctccccccagcaggttaaagacctgctagttagcaacgagagcggatggaggacagtcattggaaccacaggggcctaatacccatttgtattcacactcagaccctttaagcatataaaaccggagaggttgaactgtttacattcacctaatgctccagtaaacaaatcagagccccagtggagggggtttcaggcagggctgcggccagaccccactgggtgccaggcagcaggagcaggatggggaaggaagaaggtagatgcatggaaaacagaagccaggctctcatcccaacccactcaagtttctccccaagcctgggccctccttgaccccacgcgacaggggagcagcccttccaggcctgagctccaccaccctccatggacaggtgacctcagctgccagacacctccttaccccctacccccagtaccctggagccctgccagcacccccacataacccaccaatgacctggagaggaggacagaagaggaacggccttgcaaagcacctggagaaaaaggggttaaatgcccagtgtctgactgagggagaaacttcccctcccttccaggcgcctccgagggttcgtcctcaactactattgttattcaagaactgcgtcttagctgagcagctcccccgccgccccccagcactgggtcttgacagaagtgaagcggggctgcctggtgtcccagcacagggcctgatcatatcctctaaaacgtgaacagtttcaacttgactggggggaaagggggcaggcggggggtggggggggactggcactccttttaaatgcagatttgaacttttcacccggggtcagacagctgcgatgctctgtccccagcagaggccagcgccggggccccttccacctcacactttcacagtttttttcctgcctgccaggaggccagcctgttaaaggaattcgatacctccctccctccaaacccaaatccacacccgcttctcagcttaccaggggcacaaatcccactggcatcctagaggagagcctcaaatcgtaggaggctggctgggtgctctgggaacagcaatggcaaaggaaaattgttgttgtcacatgtattgaccaaggaacgctaaggtcaacagtgagaagactccaggacttcccggccgctctgaaagcatctgaaagcagcatcttctctagggtacatttcacagtggcgctttctgctagaagccagcagacagttctccttgctatttcactgagaagagctgtaatggtaccaaggctgaaatcatttagttttgaaaagaagtcacttctgggtgaacaagaaaaactgtaacgaacttaaaaaaaaaaaaaagtctaggatgggactgcttgcctccattacacccctgattctcatggacaaggttgtttctgagttttccatgtcaccctctgtccctccatttctcctcctccaatgggagacgcccactggtcctcgactagggaaggtttccattccgcggcatcaagataaggcaagaaagcagaaatccaaataaacactaagagaagaaggcgaggggaagtttcttgctggaatcggtgaccctcccaacagtggcagctcctacaactctcatcttggggggcactagagcctctaagagaaagtcccctccaagcaatgcaccacacagtccctggactagccaaaccggaagcctgtgtgtgtggtgctagaaatgactgtgaagtcagaaaaaccacaccaattacctacaggtagaaggttctagattcatgccttcctcctgccccaaactagcaacccaccacggagagggtgaaacgagcatttctagaggctccctgcagccctgtctgtgatttcagtaatatacatgaagcagtaagtctgttgtaacaaacacactagcactcacaggaatgaatgagagtggggctgtcccctgaggaggtggcccgtgccttgctgccactgctggtcttctgcctctgggaaggttttcacagtcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttctcggatatgactgagacagacttctcttgtctgtcttgaacatctccctaaagctacaatgtactggctcccaaatgatacttttaaatgggctgaacaatcttagtatccaacaactcactgccaaactcaagtataaactaagaaaaaataaatcacttctgggacccacagcgtgcttttaaaaaataataataggccaggcattgtggctcacacctgtaatcctagcactttgggaggccgaggcaggtggatcacttgagctcaggagttcgagactagcctggccaacatggcaaaaccccgtctctactaaaaatacaaaacaaaacaaaaattagccgggcatggtggaaaaccagcccacgctggtagtcccagctactcgggaggctgaggcaggaggactacttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaatgcgctctgccgctttgtggggggaaaaggagtttaggaagaaagggatgggtggggggatgtatttctccctggtctgtccacccaaagctctatgatacgcttccacttctgtgagagtcagaaagtggaaataactcctgctcagcttctaaagagggggaggttgaaaaggcgcagggaggaggagggaggtggaggtagagggtagaggaagaggaggggagaggggccggcaggagagagggaggagggggactgggtgtatcaggggaactgcccctcccggcgctttgatcccctcggtcggtcgctaggagaaaccaacttttctccttgggttaatcaaaaccaaattactcaggaatgtggcaggacaggtctgaacttccaggtccctttgtctttgaggatttaaaatgaaaaaaaataaaattgttaaagcagatggccgtggcctactcaagaggtgaagcgaagagtctgagggaagtcagaccacatctctcaccctccaaaaaaacacacccgcaaacttcctatgccaatttattgtgagagaagttatttttgtagacaacatccaaaaatcagaagaactgcccatttcatccttactgctgcgcaaataaaagaccctcaccccaccctcccatcaactataccttgtcaaagtacaaatacaagagaaccccagatttaagatacacccgtatatcacaacccgactattaaaagcggagtccaaactagctcaagaacatacgttttccaaacacaaagtttgggagtatttttcagtgtaaagttcttccttaggaatactggggtaaggaggtattcaaatatccggttgctattcaaatgcatccatgaaatttcatggttactgtaaaattctgcatctctttaagttctaagaaaagcggtttttagggaatgactcagaggagatatgaaatgtcccactgagtgacataagatcccactgctcatctgtcgtctagaaaaagcgaagaacctgccacccagggctgttctgtttactaggaaagtctgctgggtgtgctggccagcccggcgacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattagggacagtaaaaagtgacacagcccagggcacccaggagcagaaatatgaacagcccttcgtgtgttataaaatgctgctatgcttcactgtaaaacctggctgacccccatgtcccccacccacccaaaaaagataaaataaacaaacagagcaccaccggttaagctatagagccaggattcaaaagataaagtgagaccaacacacagccatgactaccagcttgccataaatcgtaactggccccaggcatacggttatctgggaagctgcacaccaacttttaaaatactcttcaccttatctttaagcccagtcaaacacacacatacatcacccttcttagatctcggccattagtattccatttagactttccaaaacaaggtcatcccagagggtccttcccctctttccagtcacagctgtggactttcatccccttgtccaacaaaagggaccttgtacacaaaattaacctgaagcattagtctgtgtggtgcgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaatatgacggccacaactgcacgcggcttctgagcactggacatggggctggttctgagcgttgagaccagaacatcatggtgaaatcgtgggttgctgaaaatatctgttttaaagttaattccacctgtttctttttactttttatgaatgactactaggaaatgtacaattacatataagcttgtactctctctctctctctctctattggacagcactagagaggtgcaaatgttaccacctcaagtgctagcacattaccatgctctaaaaggaaagactcttcctttttattactattattattattattattattattattgagtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaaggctggcctcgaacccctgggctcaaacctctgggctcaagagatcctcctgcctcagcctcttgagtggctgggactacaggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatggggggagtggccgggaacctgccattgttttagaccaggagaagcaaatgtaacctctatttcaggtgttcttaactggaggcgattttgcctccccaagggacagtgggcaattcctgcagacatttttgattgtcacatcaagggaagaaggtgctactggcatctagtggggagatgccagggatactaaatgtcctacaatgcacaaggtggcccactccccccaaaaacaattatccccaaacatcaacagtgccaacacacaaccaggaagtgaccaggcctgagatccacccaagtatctctttttttatttttttatttttagtagagatggagtttcaccacgttgcccaagctgatctcaaactcctgaggtcaggcaatcctgcctaggcctaccaaagtgctgggattacaggcatgagccaccatgcacaacccaagcaaatttttaatactcagatatccaggagcaggaggggacatccctttgcaaaatggcttctctccagagctcggaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaagagtaggcctctaacagagagtctgaactgggggagtcactggcatgcccagttcaccatgcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctccacaaatcactacaaacaagccaggacaagtcaggcctattagcatacacaagccagccggggaaggcctctctaggtgggtcattgagtaggctgctcacttggagggccgcctgccagcctggggagggggacagaaggggagggctggggtggatgggggacactgtaactatttcagactctttcacttctgaacacggttgcaaagatgtcaaaaggagttggctctatttccaccccatggggaagaagagaattgctggaccttttagtttatttcttccaaggtggtaagaaacgaaaggtagcagaggccatcagtagcaaagaaagaaatgaaaagggcgtggagatggcagccaatatccggagaagcttttcagtatgtgaagtggtatgaagccctgattcctatttcatttacttcccactacaaatgtaaggtatgcattaggcccattttacagacgaaagaagtgaggcccaaagaggttaaattactggtccaaagtcacacagctcaggcctcaccagagggtgtaacactgatggcctcagcagagggtgtaaggcccatagcagaggaaagagcagaggccacctttccaaagagtgggcttttttgattcacctttgcttctcccattcactgttgagtccccatttgaaggggattcacaagcagtgctctggtcctcagccagaccctgccctgttttattctgtaattatttcctaccttcaaacaaacaatgaggaagaccacacctccctccagttacacatctgggagtccgcaccaggatttcctctgtcacccaatttttccactgtctggacaatttttatagtttcaccagcaagggcaaaatatattgacagtcctttcccacaaggtgtaaaagttctctgctttccccaaatatacctctggatttcctatctgttgaaggaaaaaccagcttcgactgcctccgttaaaaaagggtgtgcagggctgaggtgaccctactaccgtcatttctgccattctttacttgaacaacattttttaagtgggcaaaatactatcttatgaaaaacaaaccaacaggggcccaggtaacacacattcatatagtcagttacacagactgaaagtcttcatcaatgcccatctcaattacgttatcaaataacataaggggacactattcaagattccatcagaacagagatggcatttaaaagcagtcgcttgagtagtgacaccaacctcctgccgcacacactgaaatccatgagcctcttctaaagtgtccaaaagttgacctgacactttaacgctgatgcagatactccacaaaaaaaagcggagctgttaaaagggaagcagaaaccattcctccagtcaaggccaaatgtacattaagaaccaaggccttgagccaaagagcattttaggaagcagggccttaaatggtggaagaggcttgcattgcttcttgagtagttaagaacaattgtttaaaaaaagaaaaaagagaagttgggagatggagaagaaaggcacccatgtgttcttcagcaacttccacgggacaaagatgttgggaagggagaagtcatcagaaataggccactcaggagactggaagcatggggagcagctcagttcatgtctacacatatgtggtttttatagactttcaggagtttaaatgcttctgaaaagcgatgtttgcatactgaagggagacagacttccatatttgaacaggcacttatatgactttttcaggggatgcagggctgagatcaactatcagattaagccccttggtctttctgcactcggctaatctgcctcctgcctctccactaaggagattcaaatgagaagacagaggcagtcgcctctgaactagaatcttcctactgaaatgcagagcctatgatagaaatgggcaccggggaccatctatccaaaagccagcctaaccgatacactcagaagaatttttctccagtcacactcctggatggagtcaggaacaaccaagaaacaagcaaaactgttcttttgcctcctccttcctgaaagaaccccatcaagaagcctacacatgacccctccagtgtgtaagccccaatcatgcctaaccaccccaaatcaccccaagtactcagccctactcaataactaacaccctctcccatctacacagaacagcgggtataggcagtcactgactcctgccctagaagcatcgggcgaggggtctcactcccagatcaaaggtttgtggccaagataacttttgggacagtggatgaaatcagcagcagatgaaaactccacagcctttttcagagtccagtggagccagttctcccacttccagtccaagtctccctgcagatgactgaaggtgatccatacattcctaactgctgccccgaaagacccacttacaattaaactccaggtcaccagttaagaaagcctttaggccccttatgtcattagcttcctcccagaaaccaagcagaatagaaagtgagaggcatcccagcaccggcccatcttctcaaggtgtggccttgcaagggagtttcagtggcttcatcccaaaccaccagcagccaggagtaggggtgggagtgcggcagatgttttgcccgcctcactggaagctttagacctgactccagggagggaaaaggatggacaaatctcagaggcagcacatgtgttaataccaaagctcaaagaacacacagcagaaccacctaagacctccaggacacagcaagccagctaaggcccctctggaaaggtacacatcaaaccccccacacagtaatcctcatgttgagactgctgtggtgaccctctgatggacagggagagggggtcacccaaaaggcagatgaagcccaggcattttgctaagaggcccgggctggagttaaaaccaacaaaacagaagtcttgcttcaaaatggggctgaatttgccatctcgcaaactttctatgtctccctccctgtttttatttgagcccttattcttgtaaaagcaagaaactccatgaatgaaggctgaaaggcagaaacgtcaaagaaagaaaaaatcccctttaaatgttaaaagccaaagtactttccttgggcaaataactctctagagacacccccatcactgcctagaccacggccttgtcctcacccacctgtcccctggcccaaagaatgaaaaccagaaacattccagtcgtttccctacttctgaagcttcagctcagtgctgctgtcaatcggcactaagccttgctctgcacctctgtcctcagtttctgtccatatcaaagtcatttaccatattagcccaaagaagccctccaacatctgattgccactttgcacatgttcaaagagatcaatctggcagtcaactttaaatcatagagaaaagccctctgacagttgttgattttgtagtgcttctctttaatctggattttcaaagtggcttgccaatgagccaagatttctgcctgggtctctccctcggggcggtttgacacaaccgtagcttctgtgtgctcctttctcaatctgagtggcctgaggacacaggacactgtgctttggacagaacaggcgccctttatgatttaaactagctcctgccaaggaattcccttgcctagattctattaaaactgggttcccatttcccctgaccatagttttttaactcaggcagaggacggtggttctgagctgtgctgtgatttctaataataaccattaccaccaaattctcataccagagcatttggatacccctatgaggttcactgtaatggaatctgccttcctgttgtgtttttacagtaacgcccccatcctggttaattgcaccagccttaggaaccagagcaagccaacaggcccaaacatcacagaaataggccaggctaacagcaagcaatcattttaataacaaatgaaagcataaaccacagcacatactgtacttcttcaggttactgacaggcatcttcagtgtgcagtacgagtgagggtgagatggagtttatataagtttgttcagaccagaatcattgctgcctacttgtaagtcaaggctaaatccttagagctgagaaacaagtgagttactcttaaaaggtgagtgtttgtttgtttgtttgtttgtttgctttgagatggagtttcggagtttcgctcttgttgcccaggctagaatgcaatggcccaatctcagctcactgcaacctccccctcccagattcaagcgattctcctgcctcggcctcctgagtagctggagttacaggaatgcaccatcacactcggctaattttgtatttttagtagagacggggtttctccatgttgatcaggctggtctcgaactcccaacctcaagtgatctgcctgcctcagcctcccaaagtgctgggattacaggcatgagccaccatgcctggccaaaaggtgagttttataaagacagctcactttcttcccctttaaataattcaagccagttccctacacttttacaaaatgttgcttagtcacttaaatatttactttttaagatgacactgttacaactctgcaataaaaataatttcttaagtaagggtctgctctgagccctgaagcatttccagattcttactgatactttgtaggtggaagaaaaaaagctcctacccctgaaagatacaccaaaaaggaacaactgcacacagtgacaataaggacatgtttcctggatgctagaactaagccacatcaccactagccctagaaatacttttccagcagtctgtaatcacagatttattctaatgaactaaccacttttgggtcaccaaagatgagccaggccggtcctgggagtgtctagcaagcatcatttaaagtcataatgatgaaaactaaatctcgcttattttagctccttgccactgggctgtccaattggcactgagttgacacagcagttaaattcaacctcaaagcagcaagaaggcaggcacttcactgtcctggtgggaagagccaggcaggggcctgtggagggcaccgttttagatgggcctttccaaccctcccttaacattcatttgtgcaaacaaaaaatggaagaaaaggaaccaaaattaagtttcaggtggttggggaagcagcatggatttacattattattattattattattattattattattattattattattgaatagttagcaagtgtttctcaatagttccctgttcatcaacactgttttcaggagaaatggaaaacagtagctctatttcatagaaagtacagccatttcaaaaaaaaaaaaaaaagtgggggggggttgttgagagagggaagtgacccatgtcataaagacagaaggtctccaagtcacttaattccttgtgattctgaaagggctgtttttaaagtctaaaagtgctcgcttctgcatctgctccatgttgttaaataacacttgtgtaattaaataaaagagccaactgtgaccccagcccactctgagaggcactttacatgctttctgaaaactatgctggaaacaccatgaggagaactccttagtcctgtaatttagcaaagggagagagaaaaagtttcttttggccatcatagctacacactctctgaaagggtgcctgcagggtctctgcaaaacagaatgaacacaaatacaggcgtgcaaacatccaggtatgtacctctctgtgaagaccccattcttgaaacccttcaattatttggaaccgtggtctcctgacttccctcacacctcacttttgccttcattgtttttcatgtttgagtagcaagagggattcagaatctcaggctgccagtggctgttctgataacaaggagcagactcatgtttcttgctacggcctttcttgatcaggttaccttggaaggtgtatgttttcctacccaatgcagtccccaccacagcactctcgtgtcctcctccagcccagcctcctggaactcgtgattttcagggtttcccttgaaacctatccagaaaccacagccattaactgaacgtgaagatttgacacctcctgaattcaggaatgagggaactcgaggggccaactctacaaactcgcacctgctgcttgacggcaaggaaacagagtttccccagctagggtgagctttaaattatacactatttatttagtgacttgtctccaaggatctcaaagcatagagagaaataagatgatgtgtaactttctcacaatctaccttcaaggctttgccctggtgcattctgacaagcaggacccagtatgaaggagaggccttccttctgtgcccaggcagagccatctgttctctctggggttttctgtcagtggctttagggagtcttcaaggactgttaaatgacacagagggtggggggagggatgaccctcctggattcacctgctcacggctttcacttaagccagtttaacacaggaggtaccactgtgccacgcaattccctcttagcacacaccatgcgtgagctgcagtctttgccctccaggccttttcctatcataacacaggtgtgtccaaggcagaaaagaacattttccagaaggttcgtttccctccaagcctacaatgcttctttttgttgttattgtttttctgctactgacctaaacataggcattcctcctcctaacaggataaaaatcttgactctctcctttgcatcagctccccaccccgcccctgcccaaggaaataaatgctctgacttttccaagagtgcgaaaaaactaaaattagagggtggacaagatgatctccaaaggtgccctccagctccaaaactctgattctccctttaattactccacaagcgcattcttcacattgtttcgaactgaccagcgacttctccagggctgaaaagggtgcatttttaggcggaggcacccaaacttctaaatgacaccagtaccacaagtattcagaaggcaggaactaatccaaaagcagactcaggaaaggaggagggaggggaggacagagggaagggaaggaaggaggaaggaagagctttactgtgtgcccagcagaatttaggcgctctcaccctaggtaggtggcaactggagtctgggagttcaagtgcatccagcctgcccttcccccacacgccccaagagaatgggaagttcagccaagactcgcagcacctgcccgcggctccaggccggctgcgcggacccggagggaggctgcactcacctggcacaccaagcctccgcgcacctccggagggaggcggcacttgcaggtccgggggccgcgccgccatgcgcaacaacgggaaattccagtggcacccgagccccgagctcacccaccccaggcggcatgctccccacctcccgctggccccaggactcggaggtggctctggtcaggagcagggggcccggagacaggggaggggagctcatggtggcggcagggctggcggtcggcccgtccccggagggaggtccccgggacgcggcggggattcacccacggggcgcggcgctggcgtccgggtccccggcctgcccgccgccgccgcctcctcctctgccgccgcccgcccggaatcgctttatgtaaatgaagcccaactcgcagtttgcagcgcgcaccgcccggggaaggggggcgggcggggcggggggccttcggggatccacattacacagcaacaaagcggaaggttaatttgaaactcacagccccgctgccgctcggctccccgggcaaagcctgacatctacagtcgtgccgggcgcaggccgggttgctcggcggcgaccgcgcccgcccgcccgcagggacccggggacgcacagggacgcgcgggacccgggcgctcagctgcgctcgctccgcttggggcgcgggccttggggcaggccgggggtcccgcgcacccgcctggggccaggaaccctcgccgctcggcctgcgccgccccgggaaccggccccggcgggaacaaagcccaggccctcccggaggcgctgacccctcgctcatcaaaggtcaggggccggcctagaatcgggcgagaagaaagggacgcgccctcggccactaaaaggagcctgaggcctccgaaccggagccatcgctccctgggccccgtccacgtcacagccaggccactcaagcatggggacaggagccaatgtggacaggaatttattggaaacacacacccatcctattaactgctttacagagcacttctgtttttcagttgcagaaacttataaaaacatccccctgctctccgttgagagtttaaggatagtttttgaggccagagaaagagaaaaggagagatcactagaaagataggaagaaaagaagtgggaagaaaaggagatgcagtctaccatgtaagcctccaggctccttagcctcaccttataaagccacatcaccgcagagatagcaaagatcgtgccctttcccagggagttcctaccgccagggtaagatttaaagcggccaccccagttggtcaaagtgattgctgggcgcctttctatctccccaagttcaccttttccagttggtcaaagcgattgctgggcgccttctatctccccaagtccacctttttccattctcatctgaaagccagccccaaagaaatctcaccggaagtcctctgtcctccctgtcagaatcccaccctcagtctgaatttactcccgattctcacagcacagaaaggcacctgcttttaccctttctgaaaaccacccacccaggctggccttacagcctggagagtcttttcctcgggcacaataatgaaccatgcaagtgttagaaatataatcagctcatgaggcgaagagcagtatgtatggaattgtattagcatgaggcacacactgactcgggagaaaaagggatgcttagctggtgaaaaccatcacatccccgtatagaaggctttttgcacaatgtaagttgggttcagattaatgtaagtatctaacctgttgggtacagacagcccctttctacattttagtccagaatagattctggggaaatttatttatttatttatttatttcagctaaggccctgggagaaaagactgcctccagggaatcatgtccgattagggacaaaggagggcacaagcccaattcagtcacacgtgagagcacgggggccgggtggggggagttaagagccaacagggaaggtggaggatgagtttgcaaaccagactatggtcactgcagagctgcttccagaccacctgacttcaggcccaagaacaggtggtgttttcaaaacacactgttatttatattggccatataagttgagaacaccttaaagaaaacaattaataatttaattgaaaaagtgactatgaataagacatgaagatgacgtatgctagcaggaccgcaagcaacgtggcccacaacgcagagatgcctctggcaatctctccggaaaaacgaagattccttacctgggataggtaaggcctgctggataaattaaagacaacaagaaaatgttgatactctcagaaaatctaattttgctgctttatcttcatttttattaacaggggacaacctcgtaatctggtgacatcatgatcctggtaggcccacagacaaataccttcaataaaataaaagctagaaagcccaaagaacaagctattaaagtaacctgggaggatgcagcactgcctgggcagaaggcccggacgggatctgccctaatactgccactgtcccaagaggcagaccctgcaacctgcctcctgcacttgagaggcctgacaagtagaactgagagtgaccctgagttccttttctttatctggcaccagctacacacatgatgaggcctagtcaagcctgcctttgttccaggcaaaaatttaacaggtaatccacaggcaggtgatctatggcctctgtacattatggaaatgagggactacacacaagctgggtgtcacctctactaaaactcattttccttattcataaaaacaatacctcttcagagggaattggcaacttctgcacttacatatgaaatcaggagttcctctgaaatactccttgcaaattctatcctccagctctggaagccctggctcttcggagggcagctgcctgatgttaaacccatggcctacccagcagtgacagcctgacattctcatcgctccatcctgaacactgctgacaaataaacccactctcagaaaaggcaattcttccctcgcagttctccatacccagtctcgtctcatctggaaagcgtaattggcaacagccgaaaggataaatatttaaaaataaatcagggagcgctaaccccttccctactcctccccttacccactctccaagccagaggcctgccccctaacgctgagctggctggtaaattacaatgattctaccgagccaaacctgcttgtctctctctttctctacacatacacacttactaatgctgtatccttccacttttgcaaaggtaaatatgatctctaagatacagtggatgtcagcattctgacttccagcgtaacctgggctctcttttcacagtacagcgggtttagacagatttgtgcacccttccgggttcttctatttttattaaattatacgtatacattgatttttaaaactagtgcttaaataacccggaggctttaacaaagaaaaatccagaagagggcaagaaacaaaaacaaacgttcctgaaataaacaaggaaccatttggagctgaattggcctgagttcaccccatgattttgaggcagttatatttaggggcctggtacccgctgggtggccgagccctcctgggtatggaacagaatgcagaagttcctcagaacagctcacatttgccttcataaccattggaagctggtgtgccaaggcctgcacacagatgttttgattcacatttttctgctgaagcctcaaggcctccatccatccctacagtgctaattccatagattaatttttacccccaaatcgtaggtggaacattatctaatttccttacccaccctccccagctcaggtgctaaatctgtcaatgatatcccacaacaaagatacaaatgagtaaccattttttaaaagctgtgatttcggagagtttttctaaattaattttaagttacaaagccccaagttttaagaaagccaaaatacagaagttgccttaaaacagctttacatgttaggtaaagagctctctctctctttctcgctccttcttttttaaacaaaaatattatttctgaaagggcaaagggaatttgccatgcaagacttttaaacacagggggattcttacatttgtgtttctaaaccttgaaattgagaattttaatgaaaaggcggacagatgcttaaggacagcatcgcaatctgggtccatacattacaggagagagaggcgctttgtttggggccaagtaaaaagaggtgggctcctattttgttcataggccattcccaccgtctgacacatccctttacagtcggtctgatgctaaccactgaattcttggaggggaagcaggttggaaggagaagaaaggaaaagggaaacagaagaggaaaagaaatgggcgatgggatactgcctgtttatacaaattgtagatttaaaaaaaaaaatcccaacacggtatccattccatagtatgtaccaaaagcactttcacacgtgagttaaaacgatccattaaatgctatatcgaaagtacaacaaccagggttggagtttattttttttttttaatgaagaattcattgaggtttgcagttctcccctattaagcttctaaggatggggcacaaggcaggaagatagacaaaagatgacctttttcacgctttcccccaaataattctagaatcctattttcctatcttttcattttagggcatttgggttcaaaaatctgtgctaatctgacttcagagcccccgagctgaaaaattcacatatcctccaagtcagccagtgttttagaatttggatttctattgaggctgttccaatcgccagtgaggcctacggtaaaaacgtgcttcatgctgtttcgtttgtctctctgcagacaaatagaaactgtgaaatttaaagaatggatgaaaaaaagaagtctaaaacaaagaggttaaaaaaataggacaaatgtttttgcttttctgtctccccggagcaattgtgtggggaagtctgcattgacaataaccatgagaaggccatctaaaggcgatgcgtacacaaggggactccttccctgctgcctttggtctgggagaaaaagtaccttagctccgttctccagaaacaaaaggccagggccacggaaggggggagaggtgacaggggctttcacatggagccaagtgtcaatgctggttcatttttcacccgtcttacttggaaagcggctcagggaacttcctaatgactgctttttccctctctccctattatttctaaacctaaaagaacaaaacaataattttttttttaacctaaaacccatcattctattagaggaaagcctttggggcctatgcagtcagattttcctctttcctttcctcatcctgcttttcttttcttttttggaggggggttccaattgtagatcacatggaaataagagacactggacactatagtcatttttagtgacaccagaacggcctttatatctacgaaaaggcaggaaacggggagaaacacacatgcacaaacaacccaacagggatggaaggcggtggtggggaggctgcgggggcaaggccttgaaacactttctttttttcacagcatgaggtccactaatgccagcttcagatttgcaactgaatcaaagtctccgagtcgtcattacaaggtttttcggtgggtgggggcatggagaagtggacaataaggatgtattaaagacacagacaaggtgtggcaggggcaaagtggggggaggtgttacaaagaaaggaagctgagatgaatcactgcgtgccatgaaaataccagggcgagtggatgtcggagtgtttaaccagatttgaagctggaagcatcttccccagcgggcaaaccctaggacgaggcacagccacgcgaccctcagcctttgaacccagacctggcagcttaggagcacactcccccttccccaggcagccacaggctctgagctgaaaggcaaggcgggggtagggataagagggccctgcaaagaagcacaatcaacaactcaaatatgaacggaaatgacgtcagcaaagtgaaggacctgtttactgcagatcaaaacaaaacaaacttccaaaccttttgtgtacacaagaaaactctataaaaagccttcctaaaatgtcaccagggtcgacacatcagcagccccacaagaaaacgcatgacagttaccatggagggaggggggaggaaaggggctgaagggaagatgatctggggggctggggggaggagtgataaaaccagaaggagcccaaaacccagttactactgccccctctgctgatccttaatatttattggtgtttataatctaaaagccatgctccacgtttcacttaatacaaggccagacagtgttgtctaatgaggtagcattacaatcagcttgtaatactgaatttttaatgctgccaaggattctgttacataataatatgaaaaacagaagctgaaagtgggctcgcaggggacaggacattcgaggttccaggcaggcgagcgccaccagcccggttcccctcccccacacccgcccccctactttctgacgtgcaatcaaccctccatcccgatacaggaggtcggtatggaaaccaggaggattttttttttttttttttttttttttaggaaatccacacttttcattattattgttattatactctcatccgaagtttatagctcaagagtttgaattctagcttttctggggttaaaggtctaaaatgaaaattaatttttttggaagaggtggcgaagagacaatacaggggaagagaggggtagcttattttaagcaaaccaagaaatttgggagaaaaatcacagagggagaaagaacttggtgggggagggaatagatgtctgccgaccatattcacagctgccgcactcagtttacattggtgtaatttaaaggcatatatatagccgccgttgctcctctctgtaataccccaagactgtaaatctataaccactgcaatgatttagtgattaaaaacatgataacatattgtgtaactgcaaaccacagaacccctgccaactctctctctctaagataaaggggaaaaaaatacagaaaatgtgttgcttgcagccatcttcctaaacccaaaagattttaataaaagaacctatacagcagacgaattggaaaggggtgagtgaattctgtgtgaagccagcaaagggagagaaaaaaaaaaaaggcagctttatgtgggattcttttccttgtactaacaaattacgacctaaacatgccttttcttttctctctctttttttttttaatagtttgttgtaactggaataactggtcttgtgcactgtcttgcatattcaaagctgctttgtaaccggatctagagacccaaccttatttgcctgaactcaatagggtttttttctccccctcctcccgggttttgttttggattcggtattgtgggttttctgttgttgctgggagcctatgtctatgcaggcataggctctggtgcctttaaaccacagaccaaacacctgaaagggggaggcacaatttgtacaatggcaggaggagcctaaaatatacaccaaaaaataaaatcaaagcagctgtaggggttttggcctctgagcagctgacctgaccccgttctgtatattcttttatttccccattgcaggattcctgcaccttgggtcagattcaaactcaatgtgaccctgaggagaaggcagtcacagagtcctgaaaagctgctccatatttaataggggtgggggaagtaagtgcatatgcatccagactcccccagtgaagacacccacacggtgcagacgtacgcgcgcgcgcgcgcgcgcgcacacacacacacacacacacacatacacacacacacacgtcaggactgccaggccatgggaccagctccaccccagttttcttggcccacaccactgagagcctgaactctctttgcgggccccccaaatcctcatacctacaactctacacacacacacacacacacacacacgcagagaacaccactcctccagagactttgtatgtttaaaaagtccacagatctgaatcgcctcctctctggaccggagcagggcagtttattcagagaaatcaataggaaagagcatttgcaaatatttatataagccctgtgcgtttcagcattaagtaattaaaaactaaaacccgaggagggggaagggagacacacagacagaggaaggctgctggcctagagtaggttttcctgcccacacctcatcttcccaaaccgcagtcttttcaaaactgactccgtgtacactttttacgaaatcctcttcgtacaccatttgctagactatttcaaaatcatctccaaatatggattcacctaccaccaagctttcaagactgactgtgtctgtattctatctctcttctcatacacacacagcaactcatacttttgacactgcgtcaatctctagtatattctcttttattttcctatctctaatatacctgcactagttaaaaaaaaaacaacaaacctaacattgtaagataagaagagggccccccaagtgcccattcaagaagcaaactcccaacccctaggtctcctgaataccccccactcccctcaacccacaggatgtctacactttgggggttcagctcctgaaacccccacatgtaaacagatttggaaaaaaaaacaacttcagcaaaatggagttttagaatgagctactatggagtggacttccctatattgttccggagggcagggcagtaaattctggttgttctccctctaaatcctctctaagaagccaagcaaggcgctggagcacccacgctgcagatattgtagaaatttacagtaaatgtaggtacacgattgcagcacgctgccctattgattatgcagattgtgatcaatcttctcccctcgcccactgcccaagcctctttcggaggacctccaaataagttggtctgcaactagctattctcccaaagtagggaggaaaaaaagtaattttttaaaaaacataataaatcctcaattgtccccactgaaagggctcgagtcttttttaaattccaaagtgaatttatgttctgtaatttgcattacagccaagcgatcaccgtctgtcatattcttcaaaggtacttaacaaactgccttttaaaagtcactagaactggaggccagaaaaaggcaatcagcatgctccgtccatacagtgcttagatcaagtttcaataattgagaccaataaaaattgtcatatttaccctacttgaaagcaacaagggggaaaagttaagactgggtgccttttgaaagcgcttgtaatcaaagaatttgccacagtccaaagaatagcacaacattgaacaaaagtcagattctgagcaacagcttcactcgcaaagtgatatatacatattttaattcaatagttatacaagaaccctccgagtactgagtccatacacaacttaattatatacactgcatgaaatacacttagatctactctccaatagatatgcaaaaagacggacattaaaatgcataatgtaaaattcaggaacacggtttttgcatcgagtggagccgggcgaggggtgagagtggggaacccaacgtaaacaatcccagattcgcgagagcaaaaaaaaaaaaaaagaagaagaagaagaaagaaaagaaaaagaaaaaaggcatcctcggatgtctctgagctcagctggcggaagaaggccggccgggcgaggtctggccctggccagcggcgcagccccgagcccccgggagcccctagtgtccagggcagagtcccctctgggcgctcgcggcgctgccagtggggcagggcggagagcgcacaggtagaggatcgcgcggccgcctcgccccctccgggaccccgtggctccgaacgggctcccgcgtcgccggcaagtcgagccccagcgcggaaggcgctcgcccggccagcggtggcggccgcggcagcagcagtggctgcgaccgcggcgactgctccgggccgggtgcgcgccccgcgcggctgctcagcccggggccccggcgcctctcggggtggggcaaagttgggggccgggagcggcgggggcgggggcactcggcaccgcggacccccccatactccccccaccgccggccgccgcctttgtctccgagctggtaccccggccgccctcccgccctcggcccgcgccccggccggccctgcctggcggcgcctccaaactcgccgcgcgggcctcgccccgggcgcctccaccctcccgggggtcgccggcggccggcggcggcggcgcggggccggggaggagggggcggcccgggctcggcggcggcggcggcggcagcggcgggaggaggaggaagaagaagagaaagagaaagtttggcgtagggggaaggcgagcgggacgcagcgagcgagcagggcgcgggcgcggggagcgcgggcggcggcggccgggcgcgagagccgggagggggcaggacgagccccatgcaaagcagcccgggcgccccgaggagccccgcgtccgggcggtggcggcgggaggaggaggaggagcaggcggcggcggcggcgggaaaaaaaaaagagggaaaagttgccacttacgcggttgcttctccggcggcggcggctgcagcggcgctgctggcgacggcggcggcggcgggagctggcggcgcttttaatcccgaaaagaggcgctcgggccgcggagcccatcaaggcagcagcggcggctggcgggggtcggcggcggcggaggacgcgctgctggcggcggcggcggcggcggcggcggcggcggagctggagcgcgctcggcggagcccggggcgggaggcggccgcagccggggagccggagccgccgccgccgctgccgccgagcagcatggttggcggggagtttacagcccccggagcgggcaggggccacggaagagaagcggcggcggcggcggcagcggctctaggctgtaattgggatgcaaagcaggcggcggcggcggctgcggccgggaggaggaggaggaggaggcggcggcggtggcggctgcagcggtcggaggggacgcgctggaagtgggagctgatgagtgaaaagaaaaaaaagtctttggatctttattctgctaattagtttcctgcaaaaaatggctgtgattaattcagtgcgcatgtgcttcattacccaggcacgacgggaagggctaattagccaccttctggatcaataagattcagcaaaaaagaaaagggggaggtggagggaggcagaggggaggaagggaggaaaaaaaaaaaaaaacaggggaaagtgatgagcagggcaaggagagcaggaagagaggatgggagaagagcctagaagagggagagaggctccaaaagtttatgcatgtattaaaaacacacacacacacacacacgacacacacacgagcgcgcgcacacacacacacacacacacacacgcacacacacaccgagaagtggaatgcataggagcaacaataggaacctggctaagaatctttttaagattttttttttcctttcttcttcccccccttctcttttctttcttattattttcccctttctctctctctctctctctctctctctctctctctctctaagcaaacgcagcaatgtttaaattaactaggaaaagagcatctccaaagaatgggggcattagtggagggggacagcttagagtaaaggtttaagtgaaagagcagagacttcgaatagagaccactttaaattgcaaatctgagattttttaactgaaggaaaattacctccccccaaatcagaggacgaatgaagaaaatatggagaaaactttaacacataccatagactagacaaaaaatatatgttaattttgtgttctgaaataagacgcaatcggtcttctctggttctttagaaggagagaggaagagaggaggggtgattagaagaaataaaagggagaaagtgaatcagaactgaaaggggataacttcaggaaagacaagaaaaggaaaagttgcacttggaaacaagtccaactttctacctttctggacttaagagaaaagtaaaatcaattttctcgtgtgaaacctggaaagcagatgttttcaaaacacaggaagctattttgccatcaaaagcagggatgtaataaaggcagtgaaaaataatttcagactgaattcataagagagaaagccaatatatttaaatatagaggaaaggcctagggtgtagaaaggggaaattacataccccttccctaatgccaaaaaaaaaaaaaaaaaaagccttacagctacctccaagagtttggagcacagtcacgaagccaaagggcttgaaatgagaggatggatttcagataaagactaggagcggtacatcccactagagcccaaaggagatccctggaatcaaagacagcagcgagggaccctactactgtaccgattcccagtacatcaaagccatcacttaggctggtgcacggtacctccaaaaagcaagcaaacaaacgcaggaagaacaagagtcagtgtctgtctgtctctctctctctctctcccccctcttctctgtctcttcccccccctttcaaatcctagcctcagcgtcactgctactgcaatagattttttaaaaatgacaagttgtatttatgtaagttctaaatatgaactaataccattgaaattacaatgtctggaataaaataaaatgcaatcagcactttaagtaatctgcaaatgtaaaaacaacatttatgtttttgaaggcattattagtaaaccctgtaacaccagatagcttgctaaaacttatttttcttgggaaaaaatgttgccctagcctaccagattatttattttagaaggaatttgggaattaatcaggaaatctgtttgattagaaagtaattcttcattttgagagattttccaatgctcttaagaacatgcagcttcttagtcaagactagagagaaaaaaaccggtttaggattttgcagggttacctcatctaatccttctgaattcactctgggaataatgctattttatttacggggggcgggggaagaaaatacatttagaaaaatcaggggtttcctctctgtgagccaaatctgggttgccattcaaactttttctggctgcttttccatgcaggacagctgatcaataaagccaagtccagcctggcttgctacaggtttcaccagtcagtgcttgcaaaacctttgtcattttctaaaaataaaaaagctaaaagttattgtagaagaaggggcttttttttgtcccctgcacaatgtgtcttttgtgaggttaatgccattctgggctctcgatagccctggacaatggggaactctctaggagcctgcaaagattctagcttttttctttcttgcctttttttttttttttttttaagggaaggatgaaacattcctacagtccaaacacaacctctactgtgattaaataaatatttatctttattgtagccattgtatatttttaccttcagtttgtccggtttctgattattattttaaatttttcaatggcaacagttaatcttttttttttccctttcagtccaaagggcaggtcagtgtaaaatgtagctgactgaaggaagactggtaaattctgaatttttccataatacatcaggtaaggaaaattgttcagaccctcaggaatatattcacttcctttttatctgtcttcacgaatcttcataaagctgtttatttttttaaagatgtggtagaattaaattcctctttgtagatcttgaaaaatcacttaaatactatgtatttattttcttttaaaatgtaaatagtactagaagtgaacttgcagcttgtttcttatataaaacggtgcggaggaagtcagtatttcctttagtataagctatttggaggaaattctggatataaatgtatttcatgttacaatataggaaaatgtcagcttaatctggtaaatacttatgctaattttactgagtgaattcgttataaggaggagaggtaccaagcttgtatgattgaataatgcttagacgataatccagcatctatatggattattttacgtacaaaatgagaaaaaaaaaaggaaacaagaaattcagaatctaaatctttcatttagctggcaagagggcagaaaattttagaccaacctgtttttaagacatttacattaggagggaaagtggaatgtaggctaaatattgcattgctgtgtacatttctctagctctcactcaaatggatatagatataaaaacacaaaaatatatgcataaaggggtacataaatatacatttgaatgacttcagatgtctttgcatttgtgtgagtatgtgaatatatctgtgcacacagatatacaaggtgtacataaattcaggtactgggcagagctgtgtgagtgctcgctcactgggggcttgtgtttccagatctgtttgaagccacttctttgcaaatataacataaaaaggttgatttaatgatgaagatgtgaatggtgaatttgagtaagaatctgcttccctgcaattatcagaatatggggttgcaatgtgagcagctattatttggtccaaaggctaaagaggcaatgggccatcttaaggggcaaggaggatgaaggggtcttaggagatctcacttggaaaaagcctagctctgggccctgggttttcttctgcagggagattggggacacagaagcaaaaaaaaaaaaggaagaaaaaagaaaaccccgtgtggaggcaggagaggttgaaaggacgcctctccgtacaactccagagctagatctaaggaaggggttggagggtgaagaatgtgcgagtcccttttcgaatgtgtattgttattctaagtctattgtatgtacgtgttgcagtcctttcatttgccacaacatatggattccataaatgcagacatgccgaagtgcatctgtctgggtagttaacatgatctaaacatccctcttcgttccgctaactccggctcttcttcgggctcctcggcagcgctccgggccagccggcccgtgccccaggcttgcagcgcccggcagcctcgtccttttgtggtctctgcacgggatccaaggtgccgcgcggaggaggcgggctgctcgcagtgccggggtcagaggcgccgccaccggcggcctctgcgcgcgcggggaggaaagggttaagctgcccgagcccggggaaggggctgctctcatcctggagcgaggtgcagccaccggcagctgtgatttaggggtcaagtccgagatcacctttctcctgcctctggaaatggcagaagatgagatagggagggagaaactagagagtggcagccaggcgcagcacgtgggctccatccatccgacacccccatcgccccggtccactccctgacccccagacaaatcggacagttcccttttctggtagagatgcggggtgcgcttcttctgagcgtccggaatcgctccatccaaggctctgccctaaggttaagccactgtgccctgagcctcaaccaccagatctcaaaagtttgctctcaatgcgccagacagtgagtagctgagtctgagtaaaaatcaccccccctccccgtttacgaaaaccaggggtccccctggcaggactaggccgtttgaatgttggtgctagaccctcagactcctgtcacagtccccacagtcgtgaggggatgtacacagtggtgcccactacatgcagcttcttgctttgtgcctgtattctttctcaggatcttgctttcccccaactcaggcggactggggaatactttggtcaaaataaatttttacacctgaaaggtaaccaaaaaccaaattcagatgtgtttctagggttttttcactggaaaagagcagagggtctgaagtccccttttgttatggttcagtgtccggcccgccaggttgagggtccccgcgcccaggtgacgttctgggggctgtagggatgcgcaccgtgcccacaaaaggcgctttaattgagaacgagcttcccaaatccaactccacgaggatggcatttaggacgacagctctttcggaaagttactccaagaaaaaggagttttttggtgggaaaagaaaactggctcgaaatgacagagagaaaagggaactagatccctggggggcaggaggcaggtggggggtgcggtgagaagataaggagatgagccgggaagtacacggacagggagtgtggggcgcggccagggaggttccgcgacgccctcccctgactctcactccagctaccagggtgagggtgaatcaccccgattttagcttctgcttccagggccaagagcagaccagctggtctagaaggcagctgaggtctgtcttctgagccctgccgcccctaaccctgccagagcctccaaaccgcggaaatcaaaccaaattggccgctcaaatctagagaggtttcatccctggggcaagggggagggaacaagccttttttttttttcttttgaactcccgattcaaaagagaccacaacctactcttgagtgtcatctccagtacatggattgtgggtatgtttcattctttcttttttcctgtttctcagaagtaaaacctttaaagaatgagccccaaacttggagcgcccggatccttgaaagagttccaaatgataaagcctgcccttcattttgaatacatggcgcattgtgaaaatgcagggcaattagtcagttccagggtttgagtcagattcccagtttcctcagcttctttgcaatggaaatctgaaatccaaccttggggcaggaggcgcggagccggtggctctcccgggttccacaccgcctgcaccgctggctagcgcctgacttcccttttggtgacctggtaggtactagaagtttgcaccacatgtaaagcctggggcgagtgaagaagagagagaactaacttcatcacagcgcaacaaagtgaacaacttgagggcaagagaccctcggtcgggctgtgttcgctttagggatttccaagggcataacttgggggaatggtagagacttcttgcttgccagccggagccaggaaaaaaggaaaccctgcgatgggcgggcggcgggcttgggagcagggctgtgagtgggcaactgagacctggctcccatctgcacatagccctcctgggccagcgccgggagacggtgcccacggtggcacgtgcattgttgacacgcagacacgcaggcgtgcgataacggagggatgcgcggctgaacaatccccccaccccaccccatgcttgcatttcttgcaggcatggcttatttaatggccagggaattgagtgcctcttacccaccacccccatcccttttattttttgctgagaaatgtaaaaaggaacctatgccgtgtacatattctgaataaacgtgagggtttttttttttcttgaggaatacctagcgccataattttgtgatttaagggggcgagggaaatctttgaaatgaaggaaatcagtgggggacgaactagcttttcctggtgtgtgtgtgtgtgtgtgtgtgtgtgtgtgtgtgtgtgtgcgtgtgtgtgtctccccaaagccagtaatgggatttaaaatgagagattcccagtcctcgtcctccctcccattccattttgctctcttcgccccagaaaacatctgcgataaccggctgcacgtctaaagggacggtttaaagagaaacagggtttggggagcgcatcaactttctctttttcaaataaagttgaaaaaaaattccaaagacaatttaagcaacaaacgacatcgaacagatatttttccaaggcaaaaaatttccgattcgttggtttcccattctcagaaatagagaaaaatgcgaatccgatcttcccgtgcgctcatgacacgaaatttggagcccgtacttggttaaggctggtgagtgcagggcagggcgtggccccacggccggcaggagtccggcgcacactgggcctggagcgcactgactggggctctggctagccgggctacccgtggggtggcctagggcccagcctgtgtcaaggctgcgggcagggcactggtcccctgtggactcggggcgcgccctctcagccgcctccctgtttaattccagagctcagcgggctgcagggacattcgacgccagtttcctcaggcccgggcgtgagacgcgcccttctcgtgtctgctcttccgtccctctgcgctggatgttgtatagcgcaggccccttccctccccgcctctcgttcccaaaaccttatcattgagaattcgacagttgccccgagatgctgatcccagttcacggagccagcgtgcgcgtccctaatgcccggcacacccatctccatttcgggacccttttttttcctgcgggctctggactcccgggaggaagcctcgggccctccggctccccggagacaccggctgaggcgcttaggccagtgcagagtcgccgcactgggacccaggcgcccctcacaggtgcacgtagggcatggcccaacggcccctcggatgggcggggaaacaggcccgggcggagcaattcgatcaccccattatgcccctgcggatgcccagaaaagccacgaggcccgggggaccgccccagcagtggtctggaaaggagagggcgcggcgaggggcgcacctcgcgcccagggcccacgccgcccaggccccgtgcctgcctccccgtcaccctaactccgcacccgggactgctggtggttcccttctctttccgccgttctcgccgggctgcctagtctctttagggccacagatgcgccctcctccccccagccccgcgggatacggaggtgagagcactgagatggggaccctgaacccaactgcaggaggacgctggacccctatgtccccaggagccccttccagccaaggcctggggagggaaggcgcctctgcacccctcagccccaggtgcaagagctgggagtggagaacccccggggccctgctcgcctccaaggcagaccagaaaccgggcccgccaaggaggcgggagtgggtgtgtggagttagcgaagggccgtctggaggggtgcctgtgcctgcgtgtttggtgctgcacgtctccctccctctcattctgtctgggaagaaaaaagaaagcgggcagatttgagccgacccctctttccgcagcctgggaacgctgcagcaggaagaattgctcataacgacacttaagccccgacagttgaatgctaaaggttaaacttacagtcttcagggaagggcttcctgccaactggaacagtggtgcgcgctgccacgggcgctcctccaccccagcctggcccctccaggtacagttcacatcacggctcttggcatttgtgaacttcagcgaaggagcccctgggtgctggcttgtccctgcccctcatcttcagggaacctctccttcctggtctcccccattattttgcctgtggctggttgagacctcagtttgtccctgggatcctgccctgtgggtcccaactagttcctgctgtgcagttggaatggacccacctttgcaacaaagatgcacggttcacacaggtggacactttggagaaactgcattcatcccttgtccctttgcacagagcactcagtggcccctgcagcttggcacagataaaaccaaggctaatacactgaatttagtgcccagccttggaggggtctgcagagagacgctggctgtaaggaggcaggcgggggattgtcaggtggaaagcttcccccaaaggaatagccaagggagtctctattccacggaccaagggcccctcccccaacccaccaccaaatgatggtaaggttcaatttagcacccctaaaaagtatattccagtaggagatagatggtaaagagaatgcagttcagctctcaggagcaagggaaggtggctcttttcctacctccctagagagcccacatttgctgagcacctaccttgccttagctccctgccaggcactttccaaataattgcattcagttctcccagcaaccctgggaaactggtattattagtcccatcttatagatgaggaataccagattcagagaggttaagtcactcacttaaggtcacacagctattaagtggctcagcttgaatttgaacctgggcctgtcaggctttaaagctatttctattacaccagttgcctctcatcaaggtcagtagaatcaggggacccaagggatgagaaaagatagatgtgtagggcagatgggctgaggcgcaggaaataaaaatattcccggaagggtgctctggttttgtatggattcagggctagattcaagactaagagacaagtcactgatgggcatggtcccccatgttattcactaaagggaaaaaggccaaaagggacaatgcaatagagaaatatcaacaaaatcctaggattacagggttggaacccatgtaacaattgcctggtgtgccccttggttttccagcctcggctggccatactagggaagttcataccaggcctttttgtttttctttgtaaattttctgactgtgtctgaagctcagacaagttccttacttctgtgagtcagcagggctaacaggaagggatgatcagatgaccaactgctcatgaaaaaatatgaggaaatccagtagacagggaataagagcaggcagagacagacatccaaaggcaggccccttgggaactcctggtcacttgagtgctccacttgcaggccctaaggtagggaaggctgtgggtggggcagctccacagctcccttgaaacaaagatgatgcctgctttgccaatattgaggtttggccacctgatggtcgtccaccaactctggcctccatgcgcactgcgggtactgaccacccctttgggcgcaactgcacaagggggaagggtggtcagtccagtggtatgggctgatcactcctcgccgtgctcggctgggttgactctgactgatgctgcccaagtatgagtgtgtgtaactgggcaggactggccaggcccacacggagaggttgctgaaagccttgttaaggaagtacttctgactaggcaatccaattacataatgctgcaaaaataactctgggctgggagtcttgagagtgacgtattttgttaacagagaggggtatcaaatatctgtcttttaacccgagggctgaaagtacacttgtgcatactgactggcctctcaccctctcccccaataagggatgttaagcgggtggcaggggggaagcaaaagaagaagcaatgatgcacacttgttttttcccctcctttttcccaggtgcaactaaagccaactgttcagtttagctatattctgccagctcacgtgtccgtctacagaatcgtgcacacccaaattagccatgcagtgctataaactgatcagggaagattaagcaaaagaaatgagggagagaataagaaatgagagaaaaacagaatgaaaggtggttttgttttattttttggtgggtagagaaggggaaggggtgaattgtctcattatattcatgaagactagactaggactcctagcttcccactaaggtgaccaactggtcccagtttacctaagactgtcccacatttaaaactgcatcttaggaacccactcatttctgaaaaactgagttggtcactccacttcccacgggctttggccaaatttccacccggtcagaaaataactggtcataatggtatatcctgtcaatccaaaattgttcgaagagtgatctaaatgagatatttcatcatggacgcaaaagccttatttccaggcatttgaagaaagatccatacacttcttcctcccactaccattttggattctagagctttccaggtggaaaaattacctgcttcattcagtttgctttcagataaagtttccagaggtccctttcccattttaaagtgccccgaactcctgccatgttttgcttgagaatcctttcataccatttttaaagaacactgcttgaaagtcattgtaccttttttcaacttcttttctgttgtggggtctccattccttcctggggcaccagggtcacacactgaactgtatcaaactcttttaatgtattctcattgaatctgttagcattttctgtttcctaatgttgataattattgcatctgatcctttcactctaaactgcggccgtgcaattcatccttaatctagatccatctgagccccttccaaagaagacacaaagataagctatccctggcccaagacactcatagcatctgagcttagattcacatttgtccccacctctattatttttttttaatcaaaatgtttccaaaccccttgagctaattataaaagcgaatagcttttcctctccgaatcatattccttgacttgtaagaatgcaattccactctgagaccaccttgtcgcagacgtgaaaacctgcttgccgaggacgcagcagagaggaaagggtgaagcgggattcgtctcccgccctccctcggcaggcactgcctttatggagtctatttccagtctgtttacctggcaaggaccacgtgaccaatccagaaggaaatgctgacatcattgtctctctctctctctctctcgcacatgtgagcctccctccctccccaggccgcctgcattccggtatccatcctctctgcctctctccagcgcccggtcccctcccccaccactcacgccttccaccacttatttctctgtctttctcatgtcacactttcctttgttttcttttccccttgcgggctggttcctagaccgtcttgcgcgcgcgcgcgcgcgcgcgcgcacacacacacacacacacacacacacacacacatctgggtgcccttttctttctccctcccctaccccgccccccaaccctcccccccgccccccgcttttcagttttttcagatctgtggccattgagccctcactcttttaaaaacacctttcctctttctctctagatttgagatttctaaattaaaaaaaaaaaaaaaagtctggaggcctaaaaagtcttctgggccaggggtagggggaggagggccaggcaaggctgcggagtccagccattcaatttcctgctccactgagcttcgagatttcggtgttgggggtttggtcaaacatgctttctttctttatttatgtacagcttctcttcttctagtctccattccacgttttcccaccctgctgctgaccaggctcccctgccttccccactgccagaccacaggtcccagcagctcctggccttgagcggagggagggagggagggagcacgtgcaactcgctcctggtcttttctctgctgctgctgctgctgctgccgccgccgccgccgccgccgatactgctgctcattctatcaggggctggggaggctgctcagcatcctcccagcctgagacccggggagctgggaaagccaggatgcagagaggaggggaggagtggcagtccatgcaggtgcctcctgcctgttcaaaggcctatttataggaagaaccagcaggcagggctctggggtttggctgctcctgggcagctttcttggtgcacgtgggcacagagccagagcatgcagtttagaggaaatgtttaataaagacatgggagcctcaaagtgtttatttattctcacagaaaggtggagatagggtgtgcctggaaactgctttgaaagcggacagcaaggtagtgaggccacagggtgacaccactgggaatcaaagggaacagctgtctcaggccaaggggcacaaggcagacactgatgggccccattgcttccacctcccaccctaggctgttctgagtgggatgataccccttttagcttggaagtgggacatggaagaagatatgaagggtcacatgagagtgagacaattaagtagtcattacttaggggtaaattcataatccccagcactcagaaaggtgggattctacctggagggcatgagtacttcgatgggtatgttcaccactgggttggatagaaaatcagaaatgtaggccaggtggggtggctcacgcctttaatcccaacactttgggaggaaggtggatcactggaggtcaggagttcaagaccagcctggccaacacagtgaaacgccattgctactaaaaatgcaaaatttagccaggcgtggtgggggcgcctgtaatcccagctactcaggaggctgaggcaggagactcgcttgaacccagggggtggaagttgcagtgagccgagatcgtgccattgcacttcagcctgagcaacaagagtgaaactccgtctcaaaaaaaaaaaaaaaaaaggaaaatcaaaaatataggatcctattggaagaccctactaagacctagaggtgggactctgaatgttaatatagtacctgccttcagtgtttgggttcattcctatttctttgtttttagagacagaatcttgctttgtcacccaggctggagtgcagtggcatgatcataactcattgcagcctccaacacctgggctgaagcagtcctcccacttcagcctcctgagtagctgggactacaggcacatgccaccatgccaggctaatttgttttacaaattttttgtagagacagggtcttgctatgttgcccaggctggtctcgaactcctggcttcaagtatcctcccacctctgtcttccaaagtgctgggattaccggcatgagccactgtgcccagcgcattcctatttctttctttctttctttttctatttttttttttatttgagacggagtctcactctgtgcccagactggagtgcattggcacaatctcggctcactgcaacctccatttcccgggtttaagcgattctcctgccttagcctctcaagtagctgggattacaggcatgcaccacaatgcccggctaattttttctattttagtagagacgaggtttcactgtgttgcccaggctggtctcaaactcctgagctctggcaatctgcttgcctcggcctcccaaagtgctaggattacaggcgtgagctaccgtgcccagcctcctattacttaagacacatttctagtactatgcccattgaaatggccctggcagccagtcagaagagaatccagttattatgaggctaccttctagagacctgttccttcagcaaagtataaagacagcagggaggggtgtggtggaagaggtcggtcatagatatgtctctccaggatcaacaggatctaaatcctcttcagatatgctggaaatctagaacttcctacaggctttaaacattttgtacaagttctaattttaaacttctaaatgtcataggccaaggacttgctggattttgtttgttttgttttttgagacagagtatcactcttttgcccaggttggagtgcaggggcacgatctcagctcactgcaacctccacctcctgggttcaagtgattctcctgcctcagcttcccaagcagctgggattataggcacctgccaccatgcccagctaatttttgtatttttagtaaagacagggtttcaccatgttggccaggcttgtctcaaactcccaacctcaactgatccaccagcctcggcctcccaaagtgctgggattacaggcatgagccaccaagcccggcctggacttgctgttttgagacatcgttaggtagataactccgttggtcaatgaaattattgttgtggcttttgattccaaataaaactagtgctggaaagtctcaatgtcattctcatcatctcaatatctcatcatttatggagccactgctaaattatgagtacggaagggtaaggtgaagcacaggttcccgactcccagctgtgggtttgagatgcctctgtcagtgaatgtgtgctcttcacttcttatcagtttttgtcaaactaaactccaagtggtggaaagatataagagagggtagagagaatcatacaaagcaaccaacccagtaggattatatgacctttattgtggcatctttcaactttggaggtatctggagaataatacgaaggaggttctttctccatctttgagtctagctgaaggctcaggctcacttcctcacgcggaccctgtcccaggcgcaatgttggaggtgacctcacccagctcctcatattcagctctctgagtgggtttcctgcatttgtgtaaaactgtacggaaaccaaaataatagcaacaagatccatttgtttcactacagaatacctgtgatgatgtggaaatgcatatgcattcataagtagatttgtattcatgttacggatgacccgcttgcttccccaaggataggcaccatatggagtgttcactgtacacatctccataaacgcccaccatgctaattggtactcagtgctgtacccatggggaagagaggataatgagaatgataatgacaatgatgacgacaatgatgacgacaatgatgacgacactaaactgcagatgccgattccaagatgaagatagttctgggcatacagacatgcttaaccaacgaggaaggagggaagggagggagggagggaggatcagatcgcattgaaacactcagtgtaagtcctaaaccaaattccttccttccttccttttttctttttcttttcttttccttttcttttttatttgagacagggtcaggttctgtcacctaggctggagtgcagtggcacaatctcagttcactacaacttctgcctctgggctcaagtgatcctcctaagtagctaattagcctcccaagtagctgagactataggtgcatgccaccacactcagctaatttttgtttttttttgtagagacggggttttgccatgtttcccaggctggttttgaactcctgagctcaagcagtccatcagccttggtctcccaaagtgctgggattacacgtgtgagctagtgcactcggcctttttgtttgcttgttttaaagcataattactctattattacctactaaaaggaagataggccaggtgtggtggctcatgcctgtaatcacagtgcttagagaggctgaggcagaaggatcacttaagcccaggaatttgaggctgcagtgagccatgatcacaccactgcattacagcctgagcaacaacaagagaatgatccccaacttgaaagagaggaagggagggagggagggagaggggacataatatctactgctgagcctgtgggctgggctagaatggcgtaacaataaaacaatcagttttcattgttggtatgtttttaaaaatatgatttagtacctaatacttctctctctcatggcaaatcagtgaggcagtgttggcagctcaggacagactcaccttacacgcaaagcctaaatgtcagagacatgatcttgcagtgatatacaatataaataaattaaaaatatatagaaaagtgaatacatacaagaaagagctacctagaagaatcaaagactttttttttttttgagatggagtctcgctctgtggcccaggctggagttcagtggtgcaatttcagctcactgcaacctccgcctcctgggttcaagggattctcttgcctcagcctcccgagtaactgggactacaggtgcatgccactatgcctggctaatttttgtatttttggtggagacagggtttcactgttggccaggttggtctcgaactcctgacctcgtgatgcgcctgcctcagcctcccaaagtgctgggattataggtgtgagccaccgcacccggccagcttttcatcataaaaatgaaacaaaatttagagaacaggaagattaccaaaggcttgggttccagtgttagctctgccactaacagctggatggcccccaacaaatcacttaatcctcactgtgtaacttctccttgtaaaatggagataacagtgcacaccccacagggttgtttcaggattaaatgagactgcaggtataaagtgtctagcacaatccctggcacatggaggggggtcaatccatggcagaaatgattaacaatattctgatatttcttacctgtcagcattgcagggttgcagcgtgaagatcaagtgattgtaaaagtattgcatgaactagaggaactgaaacaaatctaagatgttctttttaggtgttactgggctctaagttaaatctgttagtactgggaagtggagcaatgagataaagatacgttatcaaggacaaactccctatacacagatacctgatatacctcgttccagccataaagttgctgaaatacgaggaatgcaagtgcctagcagacttcctcagggggatgttgtgaagattaatagtttagaatgatgtcacagttattaaggtgcttggattccctcgagcagaggggatatgtaaatccagggactcatcataaaagtaatatcatcactgtttctcacagccgactgtttcctaagctgggatagaatttccagaagtatctttctcttttagaattacagagtatgacagatttatttccacacatctcacttgctttcagagttattgtttcctcttattccccccacctctttggtgacagagaagcctgagaaccgatcctgtcaggaatttcttggggaattttcagaagcatgtgaacacacagtatgtgaatggctgtgcgcagcggcattaactttattttataaaatatgtgtgtgtgtatatatatatgtatacgcacacacacacacacacgactgatcttccaaccatatctgaataatcaaaaccatgaatgacaaacatgtcagatacattcatcagaactcagaggatcttctaggggaattcactagcatgtcttcctcttaaaataggtcaggtaactattcccctcctttgggactctcaaaaaggatgcgctaataaatctaggccccaggataggagctcagttgccctctagacgtctaatgccaatccccaaattttctgaatttattgaccaacatgttggatggagcaggttcaagcatcttgctaaataaaatatagattatattgatcatttcccctcaatctactaaaatcttgttactctttcacagaaggaaataaatcagtttgacaggacttgttctgtcaagtgatataagttcccaacactgcattcactacagattattctagaaataaattggtaatctttttttttttccaggtgaagttccagattaggacactgcgcacttccctgtttcttttttaaaaatagaggcattagtcctgctttctttcagtctttccacgttgttaaaaatgaagtgactctcccgtgattttagccaataacaacagcttcccttataaacaactttatcctgcaaaaaatctgcttagaaaaaaaaaaaggcatatctactagtgtttaagaaacgtttaagagttcatcctgcaaaaacaatgaggaagtaaatggtcaaggtatatgacctccactttgacaagcctatttccagatctctcccatagatttaggtgttagatttagaaattatttctgaattaaatggggtcaagaccaaagacagacagagtaaatttgccgatcgtgtcaatcatgtagatctcatgcacgtcaaagccattatttttcttttttgttttttgtttgtgacagagtcttgctcccaggctgaagtgcaatgacgtgatttcagctcactgcaacctctgcctcctgggttcaagtgattctcctgcctcagcctcccgaggagctaggattacaggtggctgccaccacgcccagctaatttttgtatttttagtagagatggagtttcatcatgttgaccaggctggtctcgaactcctgaccttgggtggtccacctgcttcggcctcctaaaattctgggactacaggcgtgagccactgtgcctggccaaagccattatttttcataaacacattgaaaatccactaggcagcaaaggagaaagacaggagaaaaagtatgaaaaacctcattgtttatttgtcttaagacaaattacagtggccacaggatctgcacccttcctgaaatctcagggcttcataaaaacccaacattttcagaatacgcctggcacagagacaacctcgaagtcaaagccccaactctgtcaagaccaagacgggagcacaaaggtggcatccttgaaatgaaattcaggtatcttgggtacttctgggtatctctagggcttggggttcctaagcttaactaagatacttgcttgtttaaaggctctggaagcagaaaatccacactatccttcacaggtcacagcttggtatttaccaatctcgtgagcctgaaatttaagttcctttatcctttttctttggtctaccatgccaattcctagcccaggttacccccagccacctgcctctggattgctagacagtgctgggattataaaccgcgcctggccactaaagaacttttttttttttgagatggagtcttgctctgtcgcccaggctggagtgcagtggcgcaatctccactcactgcaagctccgcctcctgggttcacgccattctcctgccttagcgtcccgagtagctgggactacaggcgtccgccaccatgccaggcaatttttttgtatttttagtagagacggggtttcaccatcttagccaggatggtctcgatctcctgacctcgtgatccacctgcctcagcctcccaaagtgctgggattacaggtgtgagccaccgcgcccggcccctttgtttcttaaaaccaagattggaatgaacttcaacttgcctgtcacattaccttatggtgccttttaccacctcctctttttcatcatgaaatatctttgtagccttaactattatttccttccttctattctgctgtgattccactgcaaatcttccctgatctctggagtccaacccgaccaggtccttccagtccccttctctttcacttacttgtctctccccactgctgtccccacggcacacctgcctccatcactttcatatctttctcttattaaatttatttttaaggccgggcatagtggctcacacgtgtaatcccagcaccttgggaggccaaggtgggcagatcacttgaggtcaggagttcaagaccagcctggccaacatggtcaaaccctgtctctacaaaaaatacaaacattagataggaatggtggcacatgcctgtaatcccagctatctgggaggctgagtcaggagaatcacttgaacccaggaggcagaggttgggacagggcgagactctgtctccaaaaaaaaccaattatttttaattttttaaaaatagagatgggatctcactatgtggcccaggctgttcttcaactcctggcctcaagtgatcctcccaccctggcctcccaaagtgttggggttacaagcgtgagctgccacacctggcctcctatctttactccctttctacttggaaacctacacatgctgtattctctccaatcaaacaagaacaagaacagtaacacttgccttggttctactgcctttttgatgtgccatccttccattcattacccaatttcctgaagaatcatttaaatgtgttctctggcccttgcttgagcacctctggcactgtggacagctggctctgattgttagagaagatggtcattattttgagccttttaaatagatcccttgtggttcttgcctactggtcttagtgtcaccttgtgaggtcacacagagcaagtttaattccctgatgcagacaaccttttcctgtcctggcctcctctctcagtctgatctttctgagctaggaactgccagtttcttcaactctttttcacaggctctgcctctgagtcccctttgccttcctgtttccagtttgactctcttcttaaaatgtcatggcccaatattaaatgtgaattatccacatctgctctgtctcccacagtacagcaggattctcacctctttgttctcctcattacacttttgcccagtacaattgtgaaagcctccacccattaactgaaacctctaagacagcggttcagaaagtgtggctcatggagctcctacttcagaatgacccagagagcttcatgttatggactgaaagtttgtgtcctcccaaaagagggtggaactgaatgtgtaggtattttgatcacagcctccagaactgtgagaaataaatgtctgttgattgggccacctagtctatgatattttgtgatagcagtctgagctatctaagacactttaataaatggagattcttggtccacacctcaaacttgaatctgacaatctggggtagcacctgggaatccacattttaaacatttatgccaggtgactttttctttgttttttttttgagatgggatcttgctgtgttgcctaggctggagtacagtagtatgatcagagctcactgcagcctcaaactcctgggctcaaatgatccttccacgtcagcctccccagtagctgggattatcggcatacaccaccatgcctggctaatttttaaaaacattattttgtagggacagggtcttgctatgttgaccaggctctggtctcgaactcctggcctcaagcaatcctcccgccttggcctcccaaagtgctgggatttctggtgtgagccactgtgctcagccaggtgattcttaaatgtgcccaaaagtctgaaaagaaaaaagcttcaggtcttttctaatacttcttaccaagcctggctccctccacccgagtttgtgcagatgggttttcaggtccaaggtcaagacctgccattttcttgtgttacatttcaccttgctagatttggtgcattgccttggtctatcaaaaatcttttgaattctttatcttgcaacatatgatgtcatgataatcacacatggactaccaaaacctcactgtcccagcaccagaaatctcctccacattgataccaatcactaactaatttgtacttcatctttcatcttcttttccatgagataaatgagcaaattgtctttctttctttcttttttttttttttgagacagagttttgctcttgttgcctaggctggagtgcaatggcacaatctctgctctctgctcaccacaatcttcgcctcccaggttcaagcaattctcttgcctcagcctcctgagtagctggaattacaggcatgcgccaccatgcccggctaattttgtatttttagtagagacggggtttctccatgttggtcaggctggtctcgaactcctgaactcaggtgatctgcccatctcgacctcccaaagtgctgggattacaggcatgagccactgtgcccggcccaaattgtctttaaccatattatcaaatgcctcactaaagcccagctcttctttgtattctctatttccctgttccactggtagatgccaattctgtcaaaaaagaaaataaagtgttctcacaggccatttacacatgcattctagaatctgtggtcaggcaatggactctagtgtgcagaactcacccttttttccagtgacgttgttctggatgtttatggcacttatgtcataggacccttgacttgtaattataaatgttcttgtccacatctttttttttttttttttttgagacggagtctcactccatcacccaagctggagtgcggtggcacgatcttggctcactgcaacctctgcctcccaggttcaagggatcctcctgcctcagcctcctgggtagctgagactacaggtgtgtaccaccacacccagctaatttttatatttttactagagacggggtttcaccatgttggccgggctgttcttgaattcctgacctcaggtgatccacccgcctcagtctctcaaagtgctgggattacaggtgtgagccaccgcatccagccctcgtctacatcttgattcaactacgagataaggagctcctgaactctgagcttttatcttaggtgcctcaaaatatctcatggtaactagcacaagatcctacttggtaacctttctttgaatgaatgaatttttttttctcttttttgagagggagtctctctatgttgcccagcctggagtgcagtggcgcgatcttggctcactgcaagctccgcctcctgggttcacgccattcttctgcctcagcctcccgaatagctgggactacaggcgcccgctaccacgcccggctaattttttttgtatttttagtagagatggggtttcaccgtgttagccaggatggtctcgatctcctgacctcaggatccgcctgccttggcctcccagagtgctgggattacagacgtgagccaccgtgcccagccaaatgaatgaattttacattttattcccattaacttactttctttttttttgtataagatgaaagcagatcctggagtgaatactggaagactaagctccctaggcacgagggaagtggtgtgcctgggcagatctcagcagtcccaattgtttctcttagtcactgctcataaaaatcagctccttagaataaaagcagtctttgaaatgcagtgtgatgaaatcacagaaaggatgacacagtttctgaaacatcacaacattactggaatctgtagtaatggccaaagagacacaggaaacagtatttaaaacaaaacaaaacaaaacctggccaggcgcagtggctcatgcctgtaatcttagcactttgggaggccgaggtggacggattacttgaggtcaggagttcaagaccagcctggccaacatggtgaaactccatctctactaaaaaaaaaaaaaaaaaaaaaaaatacaaaaattagctgggcttggtggcgggtgcctgtaatcccagctacttgggaggctaaggcaggaggatcacttgaacccaggaggtagaggttgcagtgagccaagaccatgccattgcactccagcctgggcaacaagagcaaaactccgtctcaaaaaagcgaaacaaaaaaaccccaacaccttaccttagtagagccatctaagtcagcataacatgcagataaaacctgagttatgagcttactgctaatgagacctcttgtgatggcacaaagtgtgtcggtaggatgtgacatggctggacagggacatctggcttttctctccattatggttcccttctgtatcacaactggtaacacatctgaataattatctgatatataaaacacaaagggtgaaaagctgtaaatgaatggtggaaagtcttgtggttttcatggtcaagtgactttctttgtagtcatgcctttcctatttctttttttattttttgagacagggtctcactttgttgcccaggatagagtacagtggtgcaatcttggctcactgcagcctcgacctctcgggctcaagccatcctctcacctcagccttctgagtacctgggactacaggtgcgcaccatcacacctggttaactgttgtgttttttatagagatgcgtttttgccatgtggcccaggctggtctcaaactcctgggctcaagcgatctgcccgcctcagcctcccaagtgctgggattacaggtgtgagccaccatgcccggcctttcctatttctttcctataggccagagaagattccacagataccccagaacatgcctccactggaaagaccacacagccccagggtgacacacctgttctacgtgaggtctagggccatggttctcaactggggctgactttgccccccacatcccaagggacatttggaagtgtctggagacatttctagtagtgacaaccgacatctcatgagtagaggccacgattctgataaatatttggcaatgcacaagacacattacctccaccaacaaggaattatctggctcaaaatgccaatagcaatgatcttaataaaaatgtcatcaatgaaagcctttaagatctagaacaagaaaagaatgcacactttcaccatttttattcttgacaaagttgaagtcctagccagagaaattaggcaagagaaagaaataaagtgcatccaaactggaaaggaagaagtcaaattattactgtttgtagatgacctattttagaaaaacttagaaacaccaccaaaataacctgttagaaatgataaacaaattcagtgaagttgcaggatacacaatcaacattaaaaaattagtagcatttatatacaacaacagcaaacaatctgaaaaagaatgtaagaaagcaatcccacagctacaaaaatataaaatacctaggactaaattttttttttttttttttttttttgagatggagtcttgctctgtcacccaggctggagtgcagtggcacgatctcggctcactgcaagctccacttcccgggttcacaccattctcccacctcagcctcccaggctgagactacaggtgcctgccaccatgcccggctaattttgttttgtatttttagtagagatggggtttcaccgtgttagccaggatggtctcgatctcctggcctcgtgatccgcccacctcagcctcccaaaatgctgggatgacaggcatgagccaccgcgtctggccatacctagaaataaatttaaccaaatacatgaaagatctctacaaggaatactataaagcactgatgaaggaaattaaggaggacacaaaaagatcaaagatagcccatgctcatggattgaaagaattaatgttaaaatgtcaagagtactacccgaagcaatttacagactcaatgcaacccttatcaaaataccagatgtattctgcacagaaatagaaaaaaaaagtcctagaaccacaaaagaccccaaatagcaaagcaaacatgaacaacaagaacaaagctggaggcactgcactacctgacttcaaaatatactacaaagccatagtaaccaaaacagcatggtactagcatagaaacagccacatagaccaatggaacagaatagaaaaccagaaataagtccacacatttacagcatttacaactcattttattattattgtttttttgagatggagttttgctcttgttgcccgggctggagtgtaatggcacaatcttggctcactgcaacctctgcctcccagcaagtgattctcctgcctcagcctccagagtagctgggactacaggtgtgcaccaccacgcccagctaatttagagatggggtttcactatgttggtcaggctggtcttgaattcctgacctctagtgatccgcctgcctcggcctcccaaagtgctgagattacaggcatgaaccaccactcctgggctacaactcattttcaacaaaaaacatgcactgggcaaaggacagtctcttcaataaatgtgactgggaaaattagataaccatatgcagaagcataaagctagacccctatctttcaccataaataaacatcaatcaaaatagactaaagactaaatctaagacctgaaactatgaaactcctagaagaaaacattagggaaacacttcaggacattggtctgggcaaaaattttgggaatgagactttaaaagcacaggcatcaaaagcaaaattagaaaaatggaattacattaagccaggaagcttctgtacagcaaaggaaacaattagcaaagtgaaaaaacaacctacaagaatgggggaaaatatttgcaaactatgcatctgacaagagatcagtaaccagaatatataaggaactcaaacaactcaattgcaaaaaaaaaaaaaaaaaaaaaaatcaaattaaaaatgggcaaaagatctagacagacagacatttctcaaaagaagacatatgtatgacaaatggccaacaagtatatttttaaaatgccatttaaaaatgctccacatcattaattgtccaagaaatgcaaatcaaaaccacaacgagatatcttaccccagttagaatggcttttatcaaaacgacaaaaaatagcaaatgctggtaaagttgcagaaaaaggggaacccacgtgcactgttggtgggaatgtaaattagtacagcctctatggaaaagtggaggttcctcaaaagtctaaaaatagaactaccatatgatctgacagtgccactggtgggtgtatgtcgcaaagaaaggaaatcagtatattgaagagaaatctgcacttccatgtttattgtggcattactcacaatagcaaagatatggaatccacctaagtgtccatcaatggatgaatggataaagaaaatgtggtatatatacacaatggaatattactcagctacaaaaaaagaattaaatcctgtcatttgaagcaacatgaatgaaaatggactatcgttagcaataattttatgtatagttcacagtatctagggccaggcatggtggctcatactggtaattccagaactttgggaagctgaggcagggagattgcttgaatacaggagttcaagaccagcctgggcaacatgacaaaaccccatctgtacaaaaaatacaaaaattagctaggtgtggtggcatgcacctgtgctctcagctactcgggaggctgaggtgggaggattgtttgagtccaggaggttgaggctgcaatgagctgtgatgacaccactgcactccatcctgggtcaaagaacaagaccctgtctcaaaaaacaaaacaaaacagaaaaccaaaaccacaaaacaacaaaatagccagaagagaagaactggaatgctcccaacataagaaaatacaaatgtttgaggtgacaggtatcccagttaccctgatgagatcattacccattgttcacatgtatcaaaatattacatgtgccccccgaaataggtacaactattatttatcaattagaaaaacactaaaaacttttaaaaatttaattaaaaagtataatgaatactgccatggagaattcctggtctacgaacacagtactagtcctaaaactagacaggctggtccatctcaaagggtcatgtaactaactacctgttgtgggtttgtgaagtaagtcacagatggcaaactgtgaggtttaactggggcctctgaggatccgggaatgtgacgtgaatatgaaaccaacgtacccagcgggacaacaagaggtacagcttttcaggctaactccaggaaagtccttgtcttacagaggcacaagggaacctcatttctcctaaagcccctagacaacagatatgttttccccaaactgccattctttttgatatagccaagattttaaacatcaccagttttagatatcacagggaagctgctggatttaatgaagcctcaagatgtcccctgagagatgattataactctaattaaaaatggggggtgatggacaagaatcccctgggactctaagcaactggcatttgtgcatcttttttcatggagaagatgactttttaatgtcagtttgggctctttccaggagtcaaggatagtgtccccaaagtctaatacattttgagatttaatgtggttcaaggatcaggaaatgtcttaaattgtaagggacaaagaagtttacaagccaagccaaactttcatttctctctcttttttttttttctgagatggagtctcgctcttgtcatccaggctggagtgcagtgatatggtcttggctcactgcaacctccagcttcccgggttcaaatgattctcctgcctcagcctcctgagtaactgggattataggcatccaccaccacgcctggctgattttgtatttttagtagagatggggtttctccatgttggccaggctggtctcgaactcctgacctcaggtgattcacccgccttaacctcccaaagtgctgggattataggcgtgaaccactgcacctggcctaaactttcatttcatttttttttttctttttttttgagagagggtctccctctgccacccaggctggagcacagcggagtgatcatagctcactgcggcctcaaactcctgggctcaagcaatccttccacctcagccctctgcacggctgggatcacagctgtgtgccaccatgcccagctaatttttgtattttgtatttttcgtagagatggggtttcaccgtgttaccccagctggtctcaaactcctgggctcaagcgatccacatgcctcagtctctcaaagtgctgaaatacaggcatgaaccactgtgcctgccacatttcttttatttcatatacctgtacttaccatctccatgattgcatgaagcctagaatataagaaaccacctaaatgaattctatctgcatgtcgattctaggtatggataagaacaaaggagaaatgagtgtggcagaatgaggattagagttccatgctcaggcaagtttttggggatcaggtaggtacggcaggtcacagtaggtagtgagggcatggatccaggtaactaaatgagagttaaaacattctcaggtacatcctgaagttcaaggcaggagatcagagagactgagacaccagtgtcagaaagcagaccactgacaggagctcatcttatcacaagaagtctggtcttctaacctcatagtgctggccatgcccactactcattggacagtcttgaccctacatagatcctgaaagggaagtcagactgtttagtatccatggtgggggtccagggcaggtggcagccagagaaagcacgaggcagaaaggcacagctcgttgaaggccttaggattggatggggcctctgcatttgaacttaacatagccctgggtgaggatctcagtagcctcagacagacactcacttccaaaggcaaaggtaatgttacacctttttttaaattttaattttaattaattaattgattttttgagacagagtcttgctctgtcgcccaggctggagtgcagtgacgcgatctcagctcactgcaacctccgcctcccaggttcaagcaattctcctgcttcagcctcccgagtagctgggattacaggtacctgccaccacccccagctaatttttgtatttttaataaagacgaggtttcactctgttggccaggctggcctcaaactcctgacctcaggtgatccacgtaaagtggatcctaaagtgctgggattacaggcgtgagccgctgcacccggtctaatgttatacctttagattgtgtccttgcatctcattactccatgaacatatttttaccgaggaaaaatcaaacagcacagagctgggccaccatgaagccaactgtgtcaccgaacaagggtctaatgcaagcaacatcagggatgccactgtgattaagtgatggatgcagtgaccacactatccattgaccctgcactgactggcatgaatcagggcaggtctctgacaacaggaatcctgtgattcaagattcatccctggataggatgaatgtaccagggaaggctctcatccttgcagacacagagcctgaggcaccatgctgccctgggagactgacctgcaggctttactaatgatcgtcaagccttttgttaatgactggcaagatttgaagattcccctattagtgttcaaggctggggaattatctgtaggatataaggatgaagaaatattcctgaaccgaagctgtgcttgctttaaggctagtggcccccaagctcatctccagtcttgattgcttcccagatcctacacacaatgcacaaaatacctacctgtgatgcccaaatagggcatgtgtcctctcctgacaatgccttgcctgcaacaatatcaacccctccaggctgaggcactttttttcctaatccgtgctctccaagttcactgtaataactgtatttaaactatatctgtggggccgggcttggtggctcacacctgtaatcccagcacttcgggaggccaaggtgggcagatcccttgagctcaggagtttgagaccagcctctgcaacatggggaaaccccatctctatgaaaaatacaaaaattagccagcatggtggcatgcgcccatggtcccagctactcaggaggctgaggtgggaggatggcttgagcctgggaggcggaggttgcagtgggctgagatggtggcactgcactccaacctgggtgacagagaccctgtctcaaattaagtaaataaataaataaagtacatttgttgttgtgtacttggttatctttttcataaggcaaaaagtattctgagctcagggaccatttgtttaaatatatgagtgccacgtgcttatcacagtgcctatcacatagtatttgctcaataaatgtctatggaagcaagaaagggagggaaagcgggctggatgttaaagaagcagtaaagggtggggcgtggtggttcatgcctgtaatcccagcactttgggaggccaaggcaggcagattgcttgagcccaggagttcgagaccagcctgggcaacatggtgaaaactggcctctacagaaaaaaaaaaaaacaaaacaaaaaacatacaaaacattagccaggtgtactggtgtgcatctgtagtcctagctacttgagaggctgaggtgggagaatcacttgagcccaagaggtcaaggctgcagtgaaccatgattgcaccactgtactccagcctgggagacagagtaagatcccatattgaaaaaaaaaaaaaaaaaaggcaaggcatggtggctcatacctgtaatcccagcactttgggaggctgtggctagcggatcacaaggtcaggagataaagaccatcctggctaacacggtaaaaccccgtctctactaaaaatacaaaaaattaaccaggcatggtggcgggtgcctgtagtcccagctactcgggaggctgaggcaaaagaatggcatgaacccgggaggtggggcttgcagtgagtggagatcacgccactgtactccagcctgggcggcagagtgagactccgtctcggaaaaaaaaaaaaagaaagcggggaaaaaaaaaaaagcagtaaagaccactaatcaggcagccagcagtgtcacgcttttccaaaaggggcattggcagtaagcctgggagagacaaccttatggagatcaacaaaggagttggcaatggctttcagtggctgcagggctgtgattcccactgtgcctattggcggaaccccagggaatccctctttcttggatcagccagggacttaccttcctcgaaggccagcacacactcctgtgctggcgacacttctgcagagctggccagcagtagcctgaggttggctatgtcaaatggtccctagcatctcagagactgagccttgctcaatcccatctttatcctgtcagtttcctctgaggaccctgatatttgatattatgaccccaaatagttaaccttagttgtggtgaattgcattcatttattttacgatcttcatgggatgaaagagtttgtcgagctgagtcttcattcagaaattcgcaaaatatagcatttgacagtgccacttaattttcaaaatactatccaatggccacaaggatcactgtagctgaaaaccctgagaatatctataagggtatttcgagacgctagaatgtgatgacataggtctcttctactttcccctcaccttagcaaaccaatacattcagtattcaggatattcaacagaacattcagcacatatccttaactgctcttagaaattggttctgccgatatattagctattcagagaaagtgcttttaagttcattgttgaacatagtgatgtagtgtcttgcaatcacagaatcaacgaatgtttgagctcgaagatttcttatagacaggctagtgtgaattaaggacactaatgcccagctaaaaagggaaagtcacttagtaacttgcccaagaacacgcagctagtgcgtagttgaaccagacttgaaagcaaacatcatgatcataagccacctttctgccactgcgtgttgatggtatgaagataccatatatatatttacacatgcacacacaaaaaaggataaagtcttgcatcacatagagccagttgtctgaagaaactgtcagccctactgaaacaatatcccatttaagtttaagacagcctggtgaggcccagagcctcaccagtcccccagaaaacggagtattgtttccatccaaaccttgcactgaaaggagcctgtcagcaggaagtgacctcgtgagacaactgtggggagagcaaagggccggggagagaaaggcctcattctcactgcaaacaggaaaaggaaagagaaaaagcaagctctgtctccacacaaggtttgctgggctggctatgaactgttccagtacgttccatcaaatagacgccttcatagaatcaagccgagcgcgaacgccgtgtctggggctcccactcccgggacacacacgcgggctggcttacacatgctcttgctctctcgcgctctgggagagcgcttatatgggcttcatgaggctaagtaataaacactttgtcttcaccctgctatttatgggttgcttggggcatcctgtgctctccactgcccttacctgaacagacggctcatgcagacccggagtttaatagggacaacagtaaatctgagaggctgtgtgtgtcccacgcgctcctgttttcccagccacccatgctagttgcagagaaaagccaacctgtatcccttcgtttatgctctgtgtgcccttcctggaggtgaaatcccttctcctttttcttcgggcccttgttttcttccatcctttcaaacatctctctaacatatccttttgctatttgacccctcccagagatcccttcattcttcagcaatggatcaaagaactctgaaaacaagaacaaccccgacagctgcaaaccacgagccctcacctccagcagaggttttcgggaaactctggacgaccacgcgcatgcagaggtaagggaatgatccggtcctacctggcgttgacttccaggttcactcaaaggccacgtgccaccctttgcacatcgtgtttgggttgcaaaggggaaagatgcatattgaaagccagaagtgtgcccaggccaacagacgtctgaaagccacaggggacgaccctgaaaaagtctggcagatgcagaaccacagctgatcactttggtccgtttgagggcccctttcgctcagctcttttgggggttccagggctctcagagcttccaggtcctgtaagaagagatggagtcatagctgcgccctgtccactctcgggctgtcacacaagcctggagcccagccatttctcggccttgtcttcatcttgggctaaccggtcgtctcctgcaaacagacagcacggagaaggatgagtgaactcggcctctccccacagaatacagttcgccattacagcgctgattaaatacaggacattatctcaccataatgccctcctggcggcgttcccaggaaaattctaactaatcataaaaatagaaagaaaaacgcaacctaaattccattcctcgtcttaaatgagtgatgtgttcacttttatttatttttctggaagcgaggcgggaaaagaaaatgaattttagggcttagaaaaacaagctactaatagtactaagtagagctggggcggtggtgcagacagcttagctctagcagggatgtagccggcatggcacgggtgagtcctggccctgctcctggctgaaaacttaagagtttagaactggagcacctggcagggcaaaggcaggatggggtgagggaaagttgtggggttgagtgtggacccccccaaccccctacaaatgcacacacaagctaggcgctcaatagctttcttatagcccaggtaggcaaatcctcttccaatatacctttgaaaataatgcctgatctttctccagcagcattctttttggaaacacaggcatagtttaggtatttttctccctggaaggttctttcctggaagttcacccaattaattcctactcacacattttagagatctgaacagtaagaagccttctctaagaacccctaccctgactccagtccaggggctggtcctgtaaaccttctcttcataacagccatgtgactgtaattaatgcaataactgcatagttgattgtttaacatggttgtctgtcccctcccttagattaaaaatgtgtttgtcttattcctgactttgtaagtactaggtacaaagtagctgcccaatacatgcctgtgttggatgagtgctgacgggtcacggtgggcgccaaagtggatggtaccttatgctacttcggtggggctcaggtgtagcagcaacaaacacatgtagaaccagatcacggtgggtccacaccaacaaggaccaaggaccaagctcctccctaacaatttctgctccttcctcctgtgaagtgttttttgtcgttgttgttgctgttgttattttttgatggagtcttgcttttttgcccaggctggagtgcagaggtacgaacttgactcactgcagcctccaccttctgggttcaagtgattctcctgcttcagcctcctgagtagctgggactgcagatgtacaccgtcatgtccggctaatttttgtatttttatagagatagggttttcctcatgttagccaggctagtctcaaactcctgacctcaggtgatctgcccacctcagcctcctaaagcgttgggattacaggcatgagccactgtgcgcagctccttctgtgaagtcttcatagataaaccatgggagagttaaaaatcctgaaaaccagcttctgaaatgcttatctttttttactttttattttaaatagagacaagggtcttgctgtgttgcctaggctggtctcaaactcctgagctcaagtgatcctcccactttggcctcccaaagtgctgggactacaggcatgagccactgcgcctggctctgggatgcttctcttaatattatactggatgaaaagaaaataaaagacatcccacacccatcttgcctctccctgtccccagtctggcataagaatcccacactgccagcccccatcttagctactgctgaagtaatgggcactgctactagatggcaaagttctagctgggctaattaagcagactgagctaataaccttccattttgggactggtgttattcataatttaatgtattgctgctgaaacattaacctttcgacaactggcatgttgcccacagcggcccaagtgctgaccatctttcagtaaaatgagtattattgttaaaacaggtataaatcattcatggctgcagcttttgtgtcagaccttacgtgaaagtacgcagtaagctgggtaatttatttactttttggtgattattttttatgattttatcatcatattcaatgattcataaacattggcctgatgccatttggtaatcattttacattttaaatattgtgtggctgttctgcttttcatctttaaaaacttcaggattgataccgggcaacttaattcagacacaaatgcaatttcatttgaaagaaggcggtgggtggagggggaaaagaatcccggccccttctttttaataaaccattttcaacagagctgttaggagcttccacttgttacaacattgcacttactgtagcaaactttctttgaagtttaacacacagagggtgccttgaaatctgaataaaagcacaggaaaacagttaacaagcttctggttggaaagacgatgtgattgagccaagggtggagaggggcctggagatgctggccccgggccaagaaggttggaagccactagccctcctcccagcacctggttggggaatgtgattacagtcccccagggacctggaaactctttactgcctgcctgcctgcctgctccggctgcctgccccgaattgggctcctataactgttccagaaagtagcttttgctccttatgactcccagtgctggagaccgggtggtggctgggtctttcatggtctgggagctcaggggatctccctccatctcgtaggcgctcttacagcagccctgcacatttcctaaaccaatgaaaactcagaggtcttcgtatgcaatagctgaagccgaacttctttatttttttttttgagacagagtctcactctgtcacccagggtggagtgcagtgatgcgatctcagctcattgtaacctccacctcctgggttcaagcgattcttgtacttcagcctcccaagtagctgggattataggtgtgcaccatgaagcccagctaattttttttttttttttagtagagacggggtttcaccttttggccaggctggtctcaaactcctgacctcaagggatccacctgcctcagcctccccaaatgctgggattacagggggattgcaggcacaagccaccatgcccggcattgaagctgaacttctgatggtgggaagggagtgggacaggagaaggcagagaatggggcatcatgttaaaactcttcttcaaggcagaagtatgcccgggagtaagcttgcctttagaacctcatttcatgtcaggtgtgctgggacagaggggaactcagtcaagaagactggcacctttgcccaaaacacaggagatgagatcttaaaacacagccataagtatgtgctgtaaagaaacggccacagggaaagccaaggcaagaggagaaatattttttctttgcatctcatctcatctcttctcttctctttctctgtctctctccccctccttccctcccttccttctttcgaggtggggtcttgttctgtcacccaggctggagtgcagtggcaccatcacaactctctgcagcctcaacctcccaggctcaagcagttcttctgcctcagcctcccaagtagctgggactagaggtgcttgcctcctcaccacacccagctaattttaattttttttttttttttttgtagagacaggacttgctctgttgcccaggatggtcttgaactcctgttctcaagcaatcctccccacttggcctcccaaagtgctggccatacaggcatgagctgctgagcctggcctagaaagatttctttctggacagtttgaatagggttagctctgagacagctcttactgtcttttctaacttgtttatgtaatttcccatgaatagctttcatgacttttcaactggattatctggttttaggttttacctggatttatatatacatatgtctcaagttatttaatttttcattgtgttaaaatatagacaacataaaatttgccattttacccattgttcagtgtacaattcagtgctgttcatcacactggcagtgttgtgagactatggccacgatctctttccaacatttctcgtcactctaaacgtaaactttttacccattaagcaataagtcctattccctctttccccgtccccgtggcccctccagcccctggaaacctctcatctactttccgtctctatgaatttgctattctgaacatttcacataaatggcgctgtacaatatttgtccctttgtatctggcttctttcactgaacataatgttttcaaggttcatccatgtcataagatgtatctaaccttaattcattttataccaaataatattccactgtatggatataccacattatgtttatccactcccctgttgatggacgcttgggttgttagtctctttggctattggaataatgttgctgtcaacatgagtgtacaagtatctgcgtcccttgtgtatctattttttttttttttgagatggagtctcgctttgtcacccaggctggagtgcagtggcacgatctcagatcactgaaacctctgtctcctgggttcaagcgattctcctgcctcagcctcctgagcagctgggactacaagcatgggccaccagacccagttaatttttttgtatttttagtagagacagggtttcaccatattggccaggctggtctcgaactcctgacctcgtgatccacccgtcacagccttccaaagtgctgggattacaggtgtgagccaccgtgccccacctgttttgtctttgagatggagttttgctctctcacctaggctggagtgcagtggcatgatcttggctcactgcaacctctacctcctgggttcaagtgattctcctccctcagcttcctgagtagctgggatgacaggcacatgccaccacacccggataatttttgtatctttagtagagatggggttttgccatgttggccaggttggtcttgaactcctgacctcaggcgatcctcctaccctggcctcccaaagtgttgggattacaggcgtgagccactgcacctggctgtatatctatgttttgaccatcacattttttttttcatctgatctacctttatcttggatgctctgtttgctagcttggcagagccagcgtgggcacacgtggcaaagccatttatgcctgggaattcctctctgactgtcaacgccgccgcttcaaaggacttcttgcagtcatcctctggcattgccacggctggtgctggttgtgaattctgcaccagcaacctccaccccctacattggacttgataaaacaagctgcttctcaggtatgctaaagaacaaattaagaaacagaatcacctgggatgagtgaaattccctttcaatcatgtcagccggagcagaggttgtcatgaaatttgatgttagggatttatttcctaatatacagtctaaaagggaaaacagtgtaagagctgaaatgtgaattggacatgtctatagagtgtgaattggattcaagacaaaatattgtgaatggttaatagggtcagtctaagtacacttcctgaaataatctcttggatatgcaaatattctgagagctacactgtcaaatagctattgtatcctcttatctatgtgttcacagaacggctacatgttataacaaatgaaaaatgtgaatttaaaaaataatgccaccctaaaataatactttactttgaatagcaatttttgttgtcggagttttttatttttgtcacaccagacagttaggttcttaccacagctttatttggaaacattaagagatgagctctggccgggcacagtggctcacacctgtaatccctgcactttgggaggctgaggcaggtggattacctgtggtcaggagtttgagaccagcctggccaacatggtgaaaccctgtctttactaaaaatacaaaaattagctgggtgtggttgcaggcacctttaatcccagctactcaggaggctgaggcaggagaatagcttgaaccctggaggcagaggttgcagtgagccgagatcacaccacggcactccagcctgggcgacagagtgagactccatctcaaaaaaaaaaaaaaaaaaagagagagagaaatgagctctgtgtgtcctgctctcaggaggaacagacgtggggtgggaaggggaaggagaaagcaggaacaggccaaatgttcagagtcatctgggtcatcgagtctaccatatgcatcagccatgccttggattatcttggaataccttggaacttctccttctggctacctggggccttctcagtggaatccctttcctgggaaccttgcattgtcttgaggacttgagatgctatttaaatgttcaccatctcactatgggtatcagcccattacacatgaggacagggtggggttgggggcaaggggaattcagacgaaagatacctgtggagaagccataggttttactgttgacaattccggggctccaccattgagcctctcattaaaaacattaggaagtagccaaacatactgggttttgttccatttctttttcattccttttcctaatttctgagagttgagctagtgagcagagaaggaatagacagtgcagagaagacagacagctgagggatgaccctgacatactctagaacagcccaaagcccatggtaagtattcaaaaacaccttgatcagacgaacaaataaacatcagccactaggactcaagagctgagacgatctcaccaacgggcatgcctttttctttgatctggcccaggtttgctgggtttgattaactttgcaactctttggcagaatttggttctcagaaatatcaggaagtggcagagtgcaagaaagccccttcaccatacttaaatggagacatctcccagttttctgatttccaggttagaattcaatttccaggaattcccctcttttttttttttttgagacggagtcttagtcttgctctgttacccaggctggagtgcagtggcgcaaccttgcctcactaccacctctgcctcctgggtaatttccacctcccaggttcaagtgattctcctgcctcaacctcccgagtagctgggattacaggcacccaccatcacgcctggctaatttttgtatttttgtagagatggggtttcactatgttggccaggctggtcttgaactcctgacctcaggtgatctgcccatctcggcctcccaatgtgctgagattacatgggtgagtcaccttgcccagccaatttccaggattctctaagaaaggattctgagaattaaacatggaaaacaagggacccccagcacctgactgctgctttctgctttatccatgtccttaggatccaccatgtccttgctctggtgcttcagcaccccctcaacccctgttcattctcaaaccatctaaatccacctgttccaaatcccatcagctctgagtcccgcttgccttcttcttggacaatctgatacaatctcctctgcttcactttcgattcctctccaacctgtttgtaccattagagcactgcagcaccattatatctcaattgtggtccataacccatcttctcaaaatttcaaaatttatttcaaattgatgagccccattcaagatctcctgaatcagaatttctaaggtgggcttcagactcctcagcatcactcataaatttgagaacattgtcttttggcacaagtaatataattaccgtgttgaaaggtattgctccccttttgagatggagtcttgctctgtcacctaggctggagtgcaatggcacgatcttggctcactgcaacttccgtctccctggttcgagcaattctcctgcctcagcctcctgagtagctgggacaacaggcaagcgccaccacgcccagctaattttttaaatttttttaaatttttttttttatttttagtagaggtggggtttcaccatgttggccaggctgggctcgaactcctgacatcaagtgatccgctcacgtcaccctcccatagtgctgggattacaggcgtgagccactgtgcctggccagagtttggcatttcttccagattgtattacatgttcagatttcctgcttcttgacttctttatttttgttaatgacatcactgtttcacagaccctaggcttcaaacctcaaccttccagtcctctgcacccagtacaccaccccttccaacatgcacctcactctagctgggtgctacctcttcagtaatatttcttccattctcacctcttttttttttttttttttgagacaggatctcattctgtcacccaggctggcgtgcactggcgccatctcagctcactgcaatctccgcctcctgggttcaagcgattcttgtgcctcagcctcctgagtagctgggattacaggcacctgccactgcgcctggctaatttttgtgtttttagtagagacgaggttttaccatgttgtccaggctggtctcaaactcctgacctcaggtgagtcgctcacctcagcctcccaaagtgctgggattacaggagtgagccactgtgcctggcctcttccatcctcacgattgctcttgcagatgaagaacttggaaatgttcacctgagctcacctcgagatgccaaatgctgccacttccagtatggaaatccagggtacacattgcccctcttttccggcatctgtccactttgtgaaatacatatctatgcatatgcttttctatttcttccactaggcttgaagctgctggaagtgaatttctttaggtcacctttgcttttctctagcataggaccttgtatatggtgctttgaaaaatatttgttgaattgaacaggtgaatttcttaatcgcaggcccactgctgacatgtagcgatgtgtgtatagatttttgaccttccaaacactttcacagtcataagcatagctagcctttctgtccttggtattgctgactgtcaatttgtctgcatttgctaatatggaaatttgaaaaaaacacacaaaaaaccaccatctgggtttgaggtgagaaccccagctctatcgcttattggacgatctttgataagttccttacctctctaagcctcagtttcatcttctgtaaaagggaagtaataatagtacctctcttacaggttgttataaaggtcaaaagagaaaacaaacgtaagtacttaacgtggttcctggcctaggtcaggcactcagtgaatggtagccattgggtactggtgttcctacatttacatctttgtttgtttgtttttttgagacagagtctcactctgttgccctagctggagtgtggtggtgcaatctcagctcactgcaacctgcacctcccaggttggatcgattctcctgcctcagcctcctgagtagctgggattacaggcacctgctaccaaccctggctaatttttgtatttttggtagacatagggtttcaccatgttggccaagctggtctcgaactcctgaccgcaagtgatccacccgcttccgcctcccaaatcgctgagattacaggcatgatttcctgcgcccagcctattatctttgaaaaggtctctactggctcccatttctactggataaggcttaaaatcctgggccgtgagtatctcaggttcccagccttgtctccccgcctcactcatgtaccccaaccttgggtaccccaaaccagactctgcctcttccttcaacaagtcctgtgcgctcacacctctaggcctgtcctccagcagttccctcctcctggagggtctctcctcccattggtggcccacagaaagatgcttggcgagaattaattacttccttatccttatttccatagctctctgaaccttcctctattacagcactttcacattgcagtacagttaatttgtttttgtatccaaactcctctgtgagtccgtgaactcctcaggggtaggaatcatagctcgtgcctccttttggcccactcacagtgcatgagcattctacggtctgatgaatattttctgtgtttactaaaatgcggagattaagcattaagtcacccaatgattgtggcagtggcctcaatgcctgtccatctggagacctcctataacagtctggtggagacttttatccgtaggcctctttacagagacattttacatagatcatcatcttcctagatcttcagataaaactaggcttgttctggcagatacggtgggaaataatgtagtaaaccaaggcaaggagtttagtgatttgaccaaagttccaaactaactgaaggcactctgattccactggtctatctcccagtctcacggctttgcatggaagctgtgtgatggtggcctccgaggaagaactggccaagtatctttgggacaaagtaaattgacatgttaggttatgaaatgcaccgatctccatccagactgttatgggaggtctccagatggacaggcattgaggccatagccacaatcatccagtaactgaatacttaatctccacgttttggaattatgtgctccctatggatttattttatgtatttatttatttattttattttttctgagacagagtctcgctctgtcacccaggctggagtgcagtagcgcgatcttagttcgatgcaacctccacctcctgggctcaagtgattctggtgcctcagcctcccgagtagctgggattacaggtgcgcaccaccacgtccagctaatttttgtatttttggtagagacagggtttcaccatgttgcccagagtggcctcaactcctggcctcaagtgatccacctgcgtcagcctcccaaagtgctgggattacaggcatgagccaccatgcccagcctcctgtggatttcaatgtgaccatttgggcaaatctctcagtgaaggagtgggacattttctttacgagagactctgggggagtacgtaccacatgaggctggttcatagttcacaggcttagctgtacaagcgtaatgggaacacacagggtctctagaaaagaacctctcagggcctcggttgacttcaggtataggcctgatcctgtatcctcttcacctggctaacttttaacatgtggctgaaaagtggctacttcagaagccttccttggccactccttcaaccccaccattctgtcccccatgtgctcctatagcattttatgttcgcttccatcatcatatggctgaatgatcaaacccaagtctgtccctcacttgactgtgagatccctaaaggcagggacctgtcaagtatgtttgtcactggaccattctgagaagaagaagtgatgcaagcatcctgcggagggaagaggactacaaaacagcaggccactgcagccatcactcactgtgcttggcgatgagctcttgcacaaatatgtccttggccactgctttctttaatagtcagttttttgttgctgggccaggagtggtggctcacgtttgtaatcccagcactttgggaggccaaagtgggaggacggcttgaggccaagagctcaagaccagcctgggcaacacagcgagacactgtctctaattttatatatatatatatgcatatatatatacacacacagacacacacatacatatatatacatatatatacacacacatacacacacacacacgtgtgtatatatatatacacatatatatacacacatatatatatatacacacacacacatatatatatatatacacacacacatatatatatatatacacacacacacatatatatatatattttttcccccaggccaggcgtgctggctcacacctgtaatcccagcactttgggaggcaaagacgggcggatcacttgaggtcaggagtttcaagacccgcctggccaacatggcaaaaccccatctctactaaaagcacaaaaatcagctgggcatggtggcgggcacctataatcccagctacttgggaggctgaggcaggagaatcacttgattctgggaggcggaggttgcaatgggctgagatcgtgccactgcactccagcctgtgtgagagagtgagcctctgtctcaaaaaataaaattaaattaaatatttttgttgttaattaaaacaaaacatttcactgcaatggctttccaagtcaaaaattcttttcatggccctcatgatcatcatgatcgagattcctttagatccagcttttctttcacccccgcatctctcccactccctatatgtacacggaccccctccccccgccccatctcctacctctgtgcttaggctcatgcaatacctgccgcccggaacgccagcctcagagccagggaatcctctccgccatgcaaaacacagtttcaatgtttctcggaagccctcctagacccctcctccctatgacctgttaggggcttctcttggttccctgagctttggctactgcctgacttttctcatgatattccaatgatttctgcccattttgctcaattagagcgcaagatctaggagcaaggatcttgtcttgttcttttttttccatgcccactgctgggtcctaggtggctggatgaattgtaaaataagaatctgtggaatttaacattcttttattatttagtgatggtgaagctttctcagctctgagaagaccttaaatgcccatgctttttgcatggtgtcagtttttgggttccaagacttttgttctagcaggatgagaacccaggattacacaagacggaagatgtacaaactctccctctctaagggtgagtgctcttaaaaggctacaaagggccaagcagtcagatggcttcatgttctatctgatatcatccctttattgtgcccttgggcctggtcaaatcagtcatcccagctcatatgacatttgcagctagtttcatgcaagatgcaaaatcttgcacggcaataactagagaggctgttgtaattctgtgcaagttggaaaaagctgggggccaatttggcctgcatagatgtgactttgtctccaagttcccatcattcatcatggaagccctgccttagaaagtttaagtaatcaaaacatttgtcaactatcaattgacaataatgatggtgcacctgtctagagttagtctgtccacttccaagggtgtcctcgtgtgacagttatgcaacaatgcacttggtcaccacatgagtaatgacaaatgggtccggacactgctatcgtctcagacattattaagttttgctaatggatgggactaacagtccatctaaccggttagcaggtgagtcacttgtaataccaaaaaagcaagcatttaagtatgtattttaaaaatcattcctctctaggctgggtgcagtgcctcatgcctataatcctagtactttgggaggacgaggcaggcagatcacttgaggtcaggagttcgagaccaacatggcgaaatgctgtctctactaaaaatacaaaaacactagctgagtgtggtggtgtgcacctgtaatctcagctactcgggactctgaggcaggagaattgcttaaatctaggaggcagaggttgcagtgtgccaagatcatgccactgcactccagactggacgacagagcaagactctgtctcaaaaaataataaaataaaataaaatataaaataaaaaaattgattcctctttagttttatatatttcatatcaaaccttattgaaaaaaggatataaggcagcttcagaaacaaaaggagatccatgttagaggtgggtgtttaaatataagccctttcttctcaaccgacaaatgttgtcacatctgcatatgacaagatatcactctactggggcatctgctttccctgactcacccaacaaggttgagaattccctcctccacatcactcctgtgcctggaacaaacctgttctgtagcgtagctcctatggcattttgagtctttattcccatgctgtgagcatcttgagggcagcaccacgcgtatttggtttggaaccccaagcacctagcacaggttttcaatcaagaatgatgataatgggctgggtgtggtggctcacacctgtaatcccactttgggaggccaaggtagcagggtcgctgagcctaggagtttgagggcagcctgagcaacatagtgagacttcgtctctacagaaaattttaaaaattagctgggtatgggctgggcgcagtggctcatgcctgtaatcccagcactttgggaggctgaggcgggcggatcacgaggtcaggagatcgagaccatcttggctaacacagtgaaacccagtctctactaaaaatacaaaaaattagccaggcgtggtggcgggcacctgtagtcccagctactcgggaggccgaggcaggagaatggcatgaacccaggaggcagagcttgcagtgagccgagattgtgccactgcactccagcctgggcgacagagcaagattccatctcaaataaacaacaacaacaacaaaattagctgggtatggtggtgtgcccccgtggtcccagctgctcaagaggctgaggtgggaggattgcttgggcctgggaggttgaggctgcagtgagtggtgatcatgccactgcacttcagcttgggtgacagagcaagaccttaccttaaaaaaaaaagagagagagagaataatgatgatgatgaggaggaggaagacgatgaagaggagaaggatgtatattattttttgtttgttttgagggtattgctctgttgcctaggctagagtgcagtggtgggatcacggctcactgcagcctcaaactcctaggctcaagtgatcctcccaccttgacctcacaaagtgctgggattacacccagtggatgtatgttattgtgtaaactaaattttggatatcttctcctccatctagatccccttctctgccggtcctggagcacacccaccagtacctctctggccccctccccatcaggccctgtggagtgcggggcacagtcctgaagtgactctggccttctccactgtggttctaacagggttaaagttgaggtttctaatcactcccatgaggtcttattacctgttgattaggtccttttgggatcagcatcaaaccgaaaacaataataaacactcccttcattggaactcagtaatgaccctgcctgccctgcaggcctggtggcgatggggaggggctctggccgttatggggctggaaacagcagcccttgttgggggcgtttgccagcgatttggtggtgcagcaaagaggtgcggctaacaagctgataggcactggttggggattctggctggccggaggcatccctgttgttccagcacaaggctcttcagaggggaccctccacagccagcctgaggacttgagagatggagctgggtggtctttccgcaggactagaggaatttctagagaatgatctggtaactgtttcacgtgtatttttccagactttttcctgtgcacattcaaatgtgagtgagtgaatgaggatgtgaacgcatgcgtgtgcataggtttcgtgtctttattacaaaaatgcaatcataggaaacattttgttctgtaaattgcttttttttcacccaacagtccatctcagacacccttccatgtcattctgttgaagcgcttcgtattaatccagaatatgaacaaagccaaatacatttaaccaacataaatgtgattgaacattttggccatctccacccgtttcttggtatcacaaataaagctgcagtgcttgctctgccagcgcatgcactaaaatcagcacgacacaggttacgtggctcctgcgcaggatggatacacaaactcgtgaagcattccgtattttttttgtttaaaaattttccggtgcagtgcctcgtgcctgtaatttgggaggccaaggcaggtgaattgcttgaggccagcagttcaagatcagcctggtcaacagggtgaaagcccatctctacaaaaaccacaaaaattagctgagtatggtggtgcacacctgtagtcccagctacttgggaggctgaggcacgagagtcacttgaacctgggaggcagaggtagcagtgagccaagatcaaaccactgtactccagactgggcaacagagcgagacttggtctcaaaacaaaaacaaaaacaaaaacaaaaacaaaaaaccaccaaaacttttcatattaaaagcttttcaaagtaaacaaaactaatgatacgacattaaagagtttcatttgggcggggcgcagtggctcatgcctgtaatcccagcactttgggaggctgaggcgggcagatcatgaggtcaggagatcgagaccatcctggctcacatggtgaaaccccatctctactaaaaatacaaaaagctactcaggaggctgaggcaggagaatggcgtgaacctgggaggtggagcttgcagtgagctgagattgcgccactgcactccagcctgggtgacagagcgagactgtctcaaaaaaaaaaaaagaagagtttcatttgttttacttttaaatcctaaaaatccttatacattttctcatgtacttgtgcaagtatctcagtaagatacattcaaacaggttgtgtctatttgcacatgaaacagtagtatctgagtatgccctttccttggtccttggataatataattttgtttgtgacaattcaattgtaataaaagatacatcagtgatattttaacctgaatttccctgacatgactttgtatttattatgtaattttaaaaacatatataattcaagttttaagaaaaattacaaaaaacactcctaaaatttccatacactctttacacaggatcactaattctttgtattttgtcccagctttttttggagacagggtcttgctctgtcacccatgctgaagtacagtggctcgatcatagctcagcctcaacctcctgggtccaaatgatcctcccacccctgcctcccgagtagctgggactacaggtgcgtatcaacacagccagctaattttttaattttttgtagagatagggtctcccattgttggccagtatggtcttgaagttctgggctcacgtgatctgcctgccttggctttccaaattgctgggattataggtgtgaaccaccgtgcctggcctagcatgttaaactaataaataaacaaatgaccaagttgcagaataataacagtaaggatgcattttatgattttatgattttatgtttttttttgagatggagtctcactctgttgcccaggccagagtacagtggcatgatctcggctcactgcaacctccggctcctgagttcaagcgattctcctgccccagactcctgagtagctgggagtacaggtgcgcaccaccacgcccggctaatttttgtatttttagtagagacgaggtttcaccatgttggtcaggctggtctcgatctcctggcctcaagtgatctgtctgcctcagccttccaaagagttgggattacaggcgtgagccactgcacccggccagcatttttctattatcctattcgattctgcttttgtttttgttttttcccttgagaatgttttgacacattgctagtgaaattaaaaataaataaacacactaatgggaggtctaacaatcatgccagcttaggggaagcagccactatttaaacattaaagaatcaaatacagttacacagcatacacagaataaaagttgacctgggggctcttgctgtctataggaaattgcaccaacccattcagaaaggaataaaaggaactctacactctcctatgtttcaactgccaagctttgctgtttatcctaagtctttacagattccatattctctgtgagggagggagggagggaagaaagaaagacagaaagaaagagagagagaaagaagagagagaaagagaggaaggaaggaaggagagagcgaaagagaggaaggaaggaaggagagagagaaaggaagaaagaaaggaaagaaaagaaaaggacagagggagggaggaaggaagggaggaagggaaggagagagggagggattcgccgtgcacctaacacattctaaacccttgccatatatgctatttcatttagtttttgaaactccaagaagcatttcttgtccccattttatggatgggaaaacgaggtttaacaaattcgtgtaagttctcaaggaacctggattcaaacttagtccttcctgactccaaagcccactgaccgtcctctaccaagaatcgctttagaggggactggagaacaggtttgcagttgtagaatcttacactggtgggtctaggtggtgcatagtccttttcctccttttctagaggtgctctagaaaacacctggggagatgccccgggcatgttggacaaacttctctccagagttttccatttctctctgctcctgtctgcccatggcacctgatctcaagagggataagaaggagagaaaaagggaagacagagaagaagagaggggtgggataatgagagaaagagaggcagaaccccaagcaggagcctacagaggagtcgacacaataggaagacagagaaaaacggaaggaagggaagaagggcagggcctgtgaggcaaggagctttgggagtcctagtctcataaattaaaaggatgacaacaaagccaggcaggaaggatttaaaaaaattttaaaaaggccgaacccagtggctggcacctgtaatcccagcactttgggaggctgaggtgggtggatcacctgaggtcaggagtttgagaccagcctgggcaacatggtgaaaccctgtctctactaaaaatacaaaaattagccgggcgtggtggcacatgtctgtaatcccagctactcgggaggctactgaggcaggagaatctcttgaacccgggaggtggaggttgcagtgagctgagatcgcgccactgcactccagcctgggcgacggcgtgagactccatctcaaaaaaaaaaaaaaaaaaaaaaaaaaagtaagtgctttcccccagtagactgagaaaggggaaggttagtgaagggcggagagaagcagcccagaccccacccacattcctctgcatccagggaggagggtcctagctgctgcccctggggcctggctgaccaggtgagcggctgcacagccccatcggagccaggcccgccctggagttatcctgcacactttggacccagcacccacagcagccctgcgccttggttcactggacaaactttggctcttcagacaaactttgaaaatccctaacttcttagggattttccctaagatccagcaaaccagccggattagtctttgggagaaaggagagagagaatatgagaaagaaagagggaatgagaggaggaagagagaagaggagttagagaaagagaaggtcagaaagaaggagagcaggagaggagggcaagaggcctggagaaagagagtgggagatggaaccaggcgaggaggtggagaagctgccagaggaagtgaagggaggaaggagacattatatattcctaggaaggaacaatataagatctttcaccacgtcccagaggtcaataaactggcctgggaaattaagaacaagttgtcattgaggattagcaaaaggcctgaggaagtacaaaaattcctgccagctttcataaagctgcctctaagaaattaaaaatcacaggccacaataaatacggcccacgtctatccacacccatgtccacatgacagcctggagaatgaggcatccttcgaggccttgctttaatgtgagtaattacaattatgcaagaatcccatgggctataatcatacacccactacgtgagctactgggaagaggcaaggaggtgaatgccagcaacaaatgcacaggaaggaacattctagaagagatatgagaaagtggaattaaacacggatggcgggtcttggttcctactaatggggtatgatgcatccatttctacattacatgggcggaaggttaaaacaaatagtttttctcatgaccaagactcttttttggaaacttttttttttttttttttttagacagagtcttgctgtgtcacccaggctggagtgcagtggcgcgatctctgcttactgcaagctccacctcttgggttcaagccattctcctgcctcagcctccctgagtagctgggactacaggcacccactaccatgcccagctaatttttttgtatttttagtagagatggggtttcaccatgttagccaggatggtctccatctcctgaccttgtgatctgctcgcctcggcctcccaaagtgctgggattaccgacgtgagctgctgtgcccggccatttttttttaagagatgggggtctcactctgttgcccaggctggtctcgaactcctgggctcaagtgaccctcccacttcaacctcccaaagtgttgggattcaggcatgagccaccgtgtctggctggaaactttcaagggaatggattttgcctgtatgttactcattttctgaggctatttggtgatggtctcacactatggttgaagataagttggaattttcttaactaaagttacctttttaatattctttattaatcaccccttaggttgttatcagaaattgggtaaactgtcagtcatggtggttcatgcctgtaatcacagcactttgggaggccaaggtgagaggatcacttgaggccaggagtttaagaccaacctgggcaacatagtgagacccccatctctatgaaaaagatttaaaaactagccaggcatggtggcacatgcctgcagtcccagctactcaggagggtgagctgggaggatcccttgagcccaggaggtcgaggctgtagtgagccatgactgcgtcactgcactccaacctaggcgacacagtgagaccctgtctcaaaaaacgtaaagtaaaataaaaaaaataaaatgggaaaactagcaattttctgcaaggaaataagttttgccaccttgtgaatggccagcctgtctttgatcacaagggcaactcacaggcaaaggattactgctatttcctaattttagtttgtttttaaagagatggggtcttgctgtgttgctcaggctggtctcatactactgggctcaagaaatcctcccacctcagcctcccaagctgtagggactacaggcgcatgccaccatgcctagctgattgcaatttctaccctggggccccaggcccttctatagcgattcctcaagagtctactgtcatagaagcagctgtcttcagcttctctccctaggccttctttgttggccaccagcaattcttggggtagccaatgtcttgaagttcaggaccaactgccggagaaaccagaccctgatcctggctgcccctcatctccaagtctcagcagacgctgctgagttggtgccttgcgggagaccattaagtccgactccagggatccaaggtctaccactgccccaagattacggggtccaggccaggcgtgatggctcatgcctgtaatcccagcactttgggaggcttaggcaggaggctcgcttgagtctaggagtttgagaccagcctggacaacataatgggaccctatctctacaaaaaaaaaaaaaaaaaaaaaatcagctgggtgtggtggcgtgtgcctatagtcccagctatttgggagactgaggtggggaggattgcttgaacctgggaggtcgaggctgcagtgaaccgggatcatgccactgcactccagccagggtgacagaatgagaccctctctgaagagtccaatgtccatacttggcttccttcagcatctcccaccttctagcatctccttgcttctagaaccagatagcaacttttttggagcacctcctcaagggcaggcgtagggctagatgctttacgtctttcatttggccctcacaattataggaggcactgctatagacagtttcacagatgaggaaactgaagcttagtgagataacttgttcaagttcacattgtttgtgatggagccactaatcaagtccagggttgcctggttctaaaaggttgctctggccaggtacagtggctcatgcctgtaatcccagcactttgggaggccaaggaggatggatcatctgaggtgaggagttgcagaacagcctgaccaacatcatggagaaaccccgtctctgttaaaatacaaaattagccgggcgtggtgatgcatgcctgtaatcccagctactcaggaggctgaggcaggggaatcacttgaacccaggaggcggaggttgcggtgagcagagatcatgccagtgtactccagcctgggcaacaagagcgaaactctgtctcaaaaaaaaaaaaaaaaaatgttgctctctgcttccactgcttcatcctgcctttagtgcttatgccctttgggtcttgaaaactgttcctaccttcaagagtctcccagatgaaatccacgtactccagagccgggttgagtgggtgggtggcgggggagtgtcccttgaaaattctgactacctcattaatggggatttgctgacagttactcactcacaggcattttcttaggacaaggagggcttggagaagaaaggctagttctcaagaggaggaatgagagtttgaaccagaaatgtgtaacaaacactccctacattgtggaatcgcaagtggagaaggccagaagtggctggggagggtgccagactccaggctgggaagctggaggcctccattttgctgaggatgaaactgtcattttttgtacctggggatgcagaccatgtacctatcaaagcttagtttagcagaaaaaattcaggatgttggagtgggttggcttcttccagcagccttcaatgaagcactttgggaggcaggctgaaggtgctctgttttccagcaagaagtcaaaggactctggttggctaagagaggttctttccacctgtggcctgtaatttaaatgaccaaaagtcctaaccctgggtactgcagggctggaaaaaccacatttttctatctcaaacccagtttattcacgcaggaatggggagggttctcagaagatgagatgagaacacagaaaaagcctggcctgcctcatcctaggctgtctcccggcttgttctggtgaacattgtctgtctaagcaagggggatgcatgtgctttgtgaagtgtctgggaacagtctgagggcatgaagaaataagaatctgcctacccaaggctattgtctttatttcctacaaagcaaaggctaaaatgaaggaagaggccacacactaggcctgaactaaaggtagtgcttcaaactctaggtatgacacattagtggactataaactcaatttgatggattgttactggcttgttttttcttttctttttccttctttccttccctctttccttccttcttccctccttcccttctttccttccttcctctttcaacagaatagaaactattagcatgtaacccatgtagtggccataaatactgttgtataataaaacttatgatttagttatacataaatacataccaatatgcacatgcataattgtatactaggtcatgaagtaaattcattctcattatgggtcatggccaaaaaatttgaaaactagtagacaggtgaagcatagagatttggggccagaaagtagaaatttccaggttgaaaacacatgatcaaacaaaacctctgactatggttacgacccaatggagttgtctagaggcaaaaatatgaaaagcctattagtttttggggggatgagtattgctaaagaaatggcaagaaagggtgacaatagtctgcaattgtttaaattgttaggtgtactttaggtcaatctctagcctcctgctatagacccaatgtgtccccacctaaattcacatgttaaaatcctaacccctaatatgatggtatttgaaggtgaggcctttgggaggtcattaggtcatgagggtggaaccctcacaaataggattagtgcccttataaaaaaggcctgagagagagctcccttgccccttctaccatatgaggacacagaaaagatgactgtctatgaaccaggaagtgagccctcaccagaaaccaaatctgctggtgccttcatcttggacttcccagcctccagaaccatgtgaaatacatttctgttgtttataagccatccagtctagagttgtttgttatggcagcctgaactaactaagacacccccaaaatcacaccagaggtagtgaattgctaaagcagtacagtcctcagagaatgcatgttcccattgccttcctcagagatgcccatgaaggacagatggacaaagaggaccctctgtggtctatattagataccaagaattctttctattgccagaggtcttaattattttttgttcttagttttttttgttgttgttgagacagtctcactctgttacccaggctagagtgcagtggcacaatttcggctcgctgcaacctccaactcctaggttcaagtgattctcgtgcctcagcctcctgaatagctgggattatagatgtgtgccaccatgcctgcctaatttttgtatttttagtagagatggggtttcatcatgttggccaggctggtcttgaacttttcacctcaggtgatctacctgccccgcctcccaaagtgctgggattacaggtgtgagccaccatgcctggcctatttttttgttcttaggatatgacatgtgcaacttcccatcttcccagagtttttattgtatacctcccattctttcttcagtgtattgggtgtattgggggtagataacttatttaatcacaggtcactggaccactaggagttacctgtgaatttcaagaagaggaatttcacaggatgtagtaattatacaagcctctgggctcttgcatttgagttgcatgcatttttatatgggtatgggtatttgtaagagtgtttctgtggaagataggtatgagtacatgttgagtagccaaaggggtgcacagtacttgacattttttggttgctacccagcacccatgtaactatcctccaccttagcagtatccagattttccttcaggtaattacatccccatgcagcccatggactttgtagcttattccagctgagagccctgaataacttgagccaggcagtaccttttatttccctgattacagtcactcctttcagggtgggcactgtgtcctgggatggtactatcatgtaaatttcaggaatcctacttgaaatgacagtgcagaaacactctctttttaaaattcttttatttttatttttttgagacagggtctcactttgtggcccaggctgcagtgcagtggtgcgatcatggctcactgcagcctcaaacttctgtgctcaagtgatcctcctgcctcagcctcctgagtagctgggaccataggtgcatgccactatgcccagctaaattttaaaacaatttttgtagagatggggccccactatgttgtctaggctggtctccaacttctgggctcaagtgatccttccatctcagcctcccaaagttctgggattacaggtgtgagtcaccacactcagcccggaagcactttctaccatggggctccgcactaaactggcagccacactgtgtctccaaggagggcaggccttaggatgagggcaacattgtggctgatggggtagagaggaaggagggctctgggcccttcattatgctcctgagcgcttggaccaaccagccgtgtggcctgctttacctttgccatgttccatgtgagccaacaggcatccttactgagatctgtttgagttgatttctaacagttacatcataggaaatataaacttcatgtattttattttacgtcttttagaaatggggtcttgctctatcccccaggctggaatgcagtagtgtgatcatatttctgcagccttgaattcctgagttcaagtggctggcttcagcctcctaagtagctgggactacaggcgtgcaacaccttgcatggtttatactttttatttttacattttttgttaggacaggggcttgctatgtttcccaggatatttacaacaaacaaaaaaacctttgttttgcttgaggctgagctttcttattccagatgtggaattgcagagcctctgtcccaggcctccaggaggctgaattcattcccagtgggttttagtggttccagccaggagtctactcctgaaagttcctctgtgctcaatttcccccatactaagtgaaatacacagttgatgtttgttttttttgtttgtttttttcacactcaaggctctttctgtccctgatctatcccttcatgacccttggctcatttcccatttctagtcctgccccttgaatcacagtaatattaagctgtttagagttccacattccatactatttttgttgttgttgttattgttgttagagacagggtcttgctctgtcaccccggctggagtgcacataagtggtgcaatcatagctcattgcagcctcaaactccgaggctcaaatgatcctcctgcttcagcctcctgagtagctgggactacaggcacatgccaccatgctccattaatttttcatatttttatttttttgtagagacagggtctcactccattgcccaggctactctcaaactcctgggctcaagtgatcctttcactttggtctcccaaagttctgggattccaggcatgagccactgtgcctggccaaaccccatacctttcttcatgtgcctttcttgatattgtttttgtttgtttgtttttctgccctatcctctctaccttttttttttttttttttttttgagacagaatctcgctctgtcgcccaggctggagtgcagtggcaggatcttggctcactgcaccctccacctcccgggttcaagtgattctcctacctcaacctcccgagtagctgggaccacaggtgtgtgctaccacgcccggcgaattttttatatttttaatagagatgggatttcaccgtgttagccagcatggtcttgatatcctgaccttgtgatccgcccacctcggcctcccagagtgctgggattacaggtgtgagccactgtgccgggcccctatcctctctactttctttgttttacatctatttatccgcttaagccaccactctccaatatggcagctgctagccatgcgtggctatggattacttgaaatgtggctactgccagtgaggaactgaattttctactttatttcatcacaattaatttaaattacaaattttaaatcaaagcaatataatatatgtttctgttaaacacagctttattgctttgataggactacattttactttaacaattgaaaatttggcatacaaattgagatgtactgtaagtataaaatatgcactggctttcaaagacttaacacaataaaaagaatgtataatatctcattaataatttttacattgattgcatagtgaaatggtaatattttggacatattgggttgaataaaatatattattaagattattttcacctgtttgtttttactttttaaaatatggctactggaatatttaaaattacacacatggcttgtactgtgtttctactggacatctttggcctagaccatttcagacagcatctccttgagaacagttttcccaatcactcaggctaggcacagtggccttctaacatctttcatgatatgttcttacataggacttattaggctggcgcagaactaattgcagctttctttttttttttttttgagatggagtcttgctctgttgcccaggctggagtgcagtggctcgatctcggctcactgcaagctctgcctcctgggttctcgccattctcctgcctccgcctcccaagtagctgggactacaggcgcctgccaccacacccggctaattttttgtatttttagtagagacggggtttcaccatgttagtccggatggtctgtatctcctgacctcgtgatccacctgcctcggcctccgaaagtgttgggattacaggcatgagccaccgcacccagccataattgtggttttcaccattacttttgaaggtgaaaactgcaattacttttgctccaacctattcatattaattatattctcttcatgaatattattattcatgaatattaattcatattgtcttcgtgtgtctctctccccactaagactataagtttctcaggggcaggaaccatattttatatttccagggcctggcacatggtaggtaccctatccatacttgtgaaattaattaatggatagccacatcaaattcacaagtatctttaaatataatttcacatacaactgctcttttttttttaagatggagtctcactctgtagcccaggctggagtgcagtgacgcaatctcggctcactgcaacctccacttcccgggttcaagcgattctcatgcttcagcctcctgaatagctggaactacaggtgcatgccaggctaatttttgtattttttttttttttagtagagacagggtttcatcatgttggccaggctggtctcgaaacccggacctcaagtggtctgcctgccttggcctctcaaaatgctgggattacaggtgtgagccactgtgcctggccacatataactaattttaggatttgttttctgtcttgcggcttcctggaggtcaagtcttttggctgtgtctctaggccaccacggggtgcagtgaccaacttggggggccatcaggggattccctgtagacaaactgtccagcccttcctagcatcctgttcctagtggggcaccagatgggcacagagcaggagtcagcagttaagggtgagccccagaaggagcagaggaaagaaaacacgaagtgaggagagcaggaagcaagacttctccttcggctttccgtggccctgggagctgagcactgctgccaagcaaacagtggtgtggaggagcgagaaggagagcccaggctggatgtggtcggccgctgggtggagttaaaatgtataacaagggagaggcaactgaagaaaagaaaagattcttttaaaaattctgctctagcctaattaaaaaaaattccactccctcatgctacgttttaagagactgccctttcagaattattttcagtctggtggtaacaggcaggaagagtgtcagatgttcaccaagctataaagaggacactccccaccctctaaaacacagggccagcccccacattgcttttctgacttgggttatgaggatacaggatgtgaagttgtcaaaggcatagatctttccggaaaggagtgtcccatgtggtagattaaaaaaaaaaaaaatggctacagtattttgcagctcctcccaccaagacgtggagtcagtttcaccagcccttgaatctgggttatactactcacgggacatcaggacacctaatgcaagcagaagcttgacaagcacttgcacagaggggtttgctctcttttgctatttttggaatccagccatcatgtgaagaagtctagactggcttactagatcctggagacacatagcctggtcacccttgtggatccctcccaggttccaggcacataagtgataccatctgggaccaccaggcctcagacagtcctcacctgactgtagccacatacacaagttcaggtgaactcaacagaagaacttccaagctaagcccaacccaaactgccagcctccaggatggtgagctaattaacaattgttgttttaagtctctaagttttggatattttaaaaatatggtgctatggtctcaatgtttgagtcacctggaaattaatatgttgaaacctaatccccaatttaggggcattaagaggtagagtctttgggaagtgattaggttatgagggtagagccctcctgaatgggactcatgcccttatagaagaggcctgggggagcttgtttgccccttctgcaatatgaagacccagtaagaagatgccatttatgaggaatgggacttcatgagataccaaatttgccagtacattgatcttggacttctcaggctctaaaactgtgagaaatacatttctattgtttataagttacccagtctgtggtgttttgttatagcagtacagatggactaagacagatggcaaaaccaaccaaccaaccaactaatacagtttgagtcacaggtgggaaaatccatgtagaaataaccactttacaaccttgtataggagagctattataatagtgtgttttggcctgttccggctgccgtaacaaaataccataaactgggtagcttttaagcagcagaaatatatttgtcccagttctggaggctgggaagttcaagatcaaggcactggggacggcagatctgctgtccggtgagggcctgcgttctggttcatagatgatgtctccttgctgtgccttcatgtggtggaaggagcaagctagctctctgggtctcttttataagatcactaattccattcattcatgagagctccacccctatgacctaatcacttcccaaagtccccacctcctgatatcatcacattgaggattaggtttcaacattcagaccataccctagagcgattcagagtgcgggctttggagccaggcaggttcagtcccaccacttagatataatcctggacacgtttgatagcaacggtaacagtgacagtacatgctttgcagggttgtaatgagaactgtgtcggccagggtcacacatctgtattaggataacttgaggagagtttataaagggactattacatctacaaagatgtggtcagggttcagggaaacacaagagagagtgtagcgcactggggttgtgatagcacccaggtgggaagcaaggacagggcatggtgacgagaagctggggacagagcaggtggggtcaagagggttgcttaacaggacccataaccttgtgttgagaaatgagtctgttctgcagtgacatggctgggagggggctgggagaatacaaactctgatctaacttcttcctcttgcctatttttgccagtgatcctcattggccaaacccaactggaagccactgggcttcaaatcagcctcctgtggcaaaaagcaaggtggagaaggtgagagagtagatctggggcaaatggaaggtatccagcccatggatttaaaagcaataatgcataggaaagccctgatcatgtacctagcacccagtcactgtttgctgtaatattattatattatcggaagaaaccaagagctgtgggtggcagaagaggaattgagctgtttttttttttttttttttgctagggtgacctgcagaatactcatggaggaggtctgctttgagttgtggcttggagagatgaagaaaataatagagcaaacattgacatggaacctactatgtgcaggtaccattctggatgtcgtacatacattaatttatttaatcttcatagccactttatggggtaggtactgtgatggttaatactgaatgtcaatttgattggattgaaggatataaaatattgatcctgggtgtgtctgtgagggtgttgcagaaggagattcacatttgagtcaatgggctgggaaaggcagacccacccttaacctgggtgggcaccatctaatcagctgccagtgcagctagaatataagcaggcagaaaaatgtgaagagagagactccctagcctcccagcgtacatctttctcctgtactggatgcttcctgccttcgaacactggactccaaattcttcagttttggaacttggactggctctccttgctcctcagcctgtagatggcctattgtgggaagctgtgatcgtgtgagttaatacttaataaactcccatatatatatatgtgtgtatatatgtatatatatatgcatatatatacacacacacacatatctattccattagttctgtccctctagagaaccctaataccgtaccattattatcccacttcacagatgagaaattgaggcaaagagaagttagataactcagtcaaggtcatacagtaataagaaatggagccaggatttgaaccaatttcaaagagggtgtgggacacagcatttgtttcttaggcacatagctgaaaaatgcacagagaggaagcagtgagtcatccacagggactagtatggggtttgtgctagagaatggggaaagacagagaatggggagagagccaaggaccagaatgatgggtggaggaatttgtcctccattctgggaggctctgggaagccactgaggacttcagagaagagaaaggcaatcacagcggggcaccaggaaatttatccgtgtgcaaggccaaactaacaaagcagggagcaactggaagccaggcaatcagcgagaggatactgcagaggtccaagcactaggtgatgagggcttgaatgaggatgatagcagcctagatggagggaagagacaagggcattgcgctgctaggggaagcacaacaggacttggggactgaagtactggatgtgtcaagcggggactgaagaaacagaaacagatgggaggtttgggagccacgtgataggtgaatgatagtattagatgtatcattcagccacacttagggtacacgttggaaaaaaagtgtacgtcagccagtcttgtgtgttctttggttgcagtgcacatgttaataagttgtaccactcccacacactgcagtcagttgcgaaatagcaatctattttgcaatatcagctcctggtaaatttcacttgtgagcctggaacaaggatgggggtggattcaaggaccgccccctgaggtggtgagaagaccagggattgcaggacattgtgagattctttctggggcagctggaaggatgcttggttgcccagcgacaatcctgcctccgcagcagtcttggtttcctgcagtcccggatgcatctcattaaaaggacagagggatggatggccgacacattttctgaagtggcattttcaacgtcctgagtcctggtatcttgtttataagtggcacttacaaaatacaagggaaagaaaaagaaaacgggagaggaagaaaggtctcctaggatctcaagcatgcagtgcgtggatcttgactctccaatttcagcttgtctaagagacggggtgcagggcctccttgaaatccacctgaaatgaattagcctgaagtaaaagtaggtgtttatctcaagtcattgcctcaaatagctgactacctgttggaagaagggtctgatcgatgcaaaccagagcagtcgtgcgtgagctgttacacagcggttagtatcgatcagagctaaaggctgccgataggaatgtggaggaaactgacaggcagagaagagggaagaaggaaacagccttcgctggtggcagccgtacagaggaaagccgataaaaagtcaattccacttaactgaatggctgctaactaaatatttttggggccagagccttcccaggtagtagctggagcatctctgttccggaactgagacatcaagcgagagccgggcatcgacaggcaagatcactggtccctggtgatggatgggggaagaagagagcccctgaatgcagagatgggaggctttgggctcagccgagctgactggggcacttgaggacagccactgaccacggagcactgctggcaggcaagaaaggaacagggtgcagactggatgttatggaacagttgctgattaattagttcatttaaaaccccgatgctttttcctgaacctcactcagtaagggctgttgaaactaatggctgcagagaaagttggacaatgcctggtcctatcacagacagaagcagaatggtgccatatagtgtagttaagagactggctgatgacttattttcctgaacttttatgccctcggaaggattgtaattctttttcttgaattagatgtgaacatgtaacttgtttggccaatgaaatgtgaatagaagtgatgcatgtccctgctgggtagaagcatttaattactggtgtacaaccttcctgttctttgcttgccactgtgatcctgcatactagtgttgatatggataagagtgaaactatctggaatgttaagcaaatggatgcatagttttccaaaactgcaatgaattttgtgtgaataaggaataaacttctattgtgtcacatcacttaatttttggccttgtttgttacccagcataactgaactttttctgactgatacaggggggctgggttttagaatcctgtctctaccagttgttactatttgggtgatttggtctatttcttaatccacccaaatcttgttttatttatatacagcacatgaaaacagcaacaacaacaaattaccatgtgctgaatgttcacaggtgcaggcacggcaaaagctctgcatatattaacttgattaattctcaaagcaaccatgtgaagaaactattcttgtcttaattttacaatcatgaaacctagtgctcagagaggttgaaagaattccccatggtcacacagcttataaatgacaggcaggaatgcaaacccaggcagaccaactccagagcactttttcttaaccattttcctatactggctctcagcttgggtacttaataaataacaggtactataagcccaggaacaaatgacactgactgacccatactcaagcactctatatggaaggagaagaagaaaaggttgcatttcttttgatcttttaccattttatactccctattctcttacaagcctctgtagagtttgatcctgtctgaaacatccttctccgcttgttccccaaatcctggttgtttctgaaagtccagatcaattccccactcatttgtgatacaaacaagggaattccttagcattagaagagaccatcagagaataccttttggaagagtttctcatctatataacggggatggtaacactcacctcatgtggttgttggagtaatggtcatgttttatcaattgaaccccaaagagatcctggggagaaaggggcattacactgagcaagtgcctacttactttgtgctaagtctctccttaaaccttccccacactcttccaaaggggataacactgaccccagatgaccggtggagaaactgagccttaaagagttgaagtgggcctggtgcggaggggcacacctgtaattccagcactttgggaggctgaagtgggcagatcacttgaggtcgggagtttctaagaccagcctggccaacacggcgaaatcccgtctctactaaaaatacaaaaattagccaggcgtggtggtgggttcctgtaatcccagctactcaggaggctgaggcatgagaatcgcttgagcctgggaggtggaggttgcagtgagccaaaattgcaccactgcactccagcctgggtggcagagactctgacacacacacacacacacacacacacacacacacagaattgaagtgatatctagtgtcagtctctattttctctgagcccatgagaccatttcacaattttgaggtgtaacagccttctatgtaccttaattaggagatcgtctttgccctctgcttgtcaaatgctggttgcttgagaaatgcattccgtttactgatatatcaacgtattgaggtgtagtgtgtgcgtgtgtgtgcatgcagatgtgtgcgtgtgtgcgtgtgcgtgtgtgcatgtatgtgtgcccacgcctgtgtgcatgtgtgcgcgcatgtgcatgtgtgtgcatgtgtatgtgtgtgtgtgtgtgtgtgtgtgtatgcccactcgccaatgtctgtgctcatgctcctttcaaccgatattttgggtatgggctaaggagagtgtgctcaggctattttaagttttgtacttaacgcttagcaattttaataaacttcattcctttaggtagtcgacttaatattttaaatatggttttaattaaccatcctccttgtgtttaaggcaaaagcaggaaaacagggaaagcgtctaacccgagagcattgccagtgattccactctttgtgacaatgaaggccagaattccagaatgcagaggcgaaagctctcccaaaattgtttcttagggcatggacctataatacttaaatcatttctaattccactgggttctgttatcccagcacagactgtaaacatttatttttgggctttcccagaaatgtgtcttatggaagggattagctgtttgcgcatgtaaagttccgaaggtgagctcctctaacctaacccacgtaattaaagtggaaaatttttggtggagggaaaaaaaaaaacatcagggaaaataccatgtttggaaagagagctgtactccgacagtctcaagagatggctctgcgttcttgggcacttaattatatcccatcttgctgtgtgctccaatgctttcatccttttggtctttacagacaataccaggatccctggcaccatacactcttctccgagagggtctacaatgtctagctttgcactgaggcagtaggcaacttgaggacaaggagagtgacactggcgtggagccagagactgggtttgccctatcattttaaaacatgatgttcattactttttaaagtgtggagtatatagggaagaaaataacaacaaaacaaaacaatagtttgtttttaagatggagtcttgctctgtctctgaggctggagtgcaatggaggtgatctcagctcacggcaacctccgctgcccgggttcaagggattctcctgcctcaacctcccaagtagctgggattacaggcacctgccaccaagcctggctaatttttgtatttttagtagagacagggtttcgccatgttggccaggctggtctcgaactcctgacctcaggtgatccacctgcctcggcctcccaaagtgctgggatcacaggggtgagccaacacgctgggcccagacagtcttattttaaaatgcaaatggctaggggcactataagacatttgtcaccaacctctatgcaactgccgctttgtgcctgagctggtggcgctggttctggagttagaccccctgggctccaatccaggtcctgtcccttgctggctcttgttaacttctttgtgtctcagcttctctatctgtaaagtgggagtaataataggacttgttttctagggttgacatgagaattcaatgaaagaacatatgaaaataccatgagcacaagtcaacgcacagcattacatagcaggacctgcaaaaggtcagctactatgcctgttatatataatgaatgcctaaatataaatcatttaaaaaaaacaactgcctttgtgaagtacttaataaacgcaattcatggtccagagtgctttatgtacatgactcatacaatctttcattcaaccctatggaagtaggttctagtaagaatccatttcacagaggaggaaatgaaaaagcaaaatgtaacttgtccaaggtcattcagctagctcaagctgggctttgagggcacgtctgattcttcctactggaccagctaagtcagacagggtacttttaagaggggaacacagagagacagagagactttaggacccagagatactagtcaaagtgtgagctgacacagtgagcctcacagggtgggagggatatccagaggagagggcgaaagcatcaaaggagctttgcctttacctgattttgcctggggccagtacaagatctgatttcttttgtggtctccaatgttgcctgcagcagggagttacgaaaagccactggatccgagtcctaaaactaggtactgtattccagttctaccacacattctatgatctcggcaactcacattcctttcccagcaagttgcattttctgggaaatggggatcaaaaatcttggctcacctacctcctggagctgttgtgaggctcacatgtttggggatgtttaactgctcggttaactagaaagcactgcacagagatgctaggtattattattggcttgatgcctccctgtgatgcaagagggatgagggtccggtgcagtggctcacacctgtaatcccagtgctttaggagaccgaggtgggaagattgcttgaggccaggagttcaagaccagcctgggcaacatagtgaaaccccatctctacaaaaatttaaaaattagccccatgaggtggcacacaactgtagtcccagctactccggaggctgatgtcagaggatcacttgagcccaggagaatgaagctacagtgagctttgattgtatcactgcactctagcctgggtgacagagcaagactctgtctcaaaaaaaagagtggagaggggatgcacttggtcctttaaaactttgatttagagaggacccaaacttgtgcctccctggagaaaactttatggtgtcagagatcctgggattgtctggaatcaattcaagaagagggaaggagactgggagcctcgtggatgaaggtattatgatagcaggtttcaggaacacgccgtaatcagctctctcttctctgtagttccactcctagcaatttggggccagctggggactggatgatgtcctctctgatgcattggaatttgtcctgcttcatggtctggtctgctataggaccacatatcacacagagacacaaagcaattgacagcatcccggccgtttcttacagatcccatatcctgtgtctaggctgtatttcaggccaacttttagtgaagtggatcaatgcttgaagcacataatgtaacatgattcttcaagggtttgattaatcgtgtcacagtcacagcctcagttcaggttcaaccttttaaaagttttattattgtataaagtgatcaatcaggaggagagggaagacaaatgctcgatgttggccatctctccctctcgtcttcgtcagcaagtgttcttctcctggtcggtttggccgatcgtgatggagaaattcatgaagatgcatggcacagcaaaatatggatcaccaaagagtgctctgagtggaaggccagctgctccagtgatgagcaaccttggcaacacatgggaggcccctggggtgttttaagaagttcagagccctgtatttcacccacagaagttctgatgcttttggtctagggcatggtctgggcatctcttgggaattctaatgtgtaactgagtgttacggtggaattatgtccataacccccagtatcccagaatgtgactgtatttagagataagacctttaaagaggtaattcggggctgggcgtggtggcttacgccagtaatcccagcactttgggaggctgaggtgggtggatcacctgaagtcaggagttcaagaccagcctggccaacatggtgaaaccccgtctctactaaaaatacaaaaattagccaggtgtggtggcgagtgcctgtagtcccagctactcgggaggctgaggcgggagaattacttgagactctgtctcaaaaaaaaaagaggtcattagggtaaattgagggcatatgggtggaccctaatccaataagactggtgtccttttaagaagaggagattcggacacagacacatagagcaaagaccatgtgaacactctggaggaagatggccagctataagccaagacgagaggcctcagaagaaaccagtcctgccaacaccttgatcttgggcttctggcctgcagaattatgagaaaataaatttctgtcattgaagccacctaatttgtggtactttctttgtggtattttgggggttcctgtccaccaatttctgttttctccatctccagatccctttcttgggacataccctgttagaagctgctctcacagtaatccccaagaaagtattagctgaacttaatgttttagccctcccacaagtgcctgcattttaatatgggattcgtacctggagtaatctaggtagctgagatgcatttggactgatggctttccagtcataattgctgtagtgatagccgatacttattatgtgccaaatactgttccaagtgctctgtgtctatctatatctatgtctacgcctatatctaatattcattcgttgaatccccccagtagccctatgaggtaggtgtgcttaaaagaggaagctgaggcacaaaagggttgagtaatgtatccaaggtctcacagatagtaaatggtagagctacgatttgaacccagcaagtctgacttcaggtaccatgcttttaaccactcacaactcagatgacctcaatggcccctagcaggatcggaacagactttgaggactagctttgtttttctaacaatagctgttagtgaccttccgtgttagtctccccacctcttttttttttttttttttttttttttttttaagagacagtcttcctctgtcgcccaggctggcatgcagtggcgttatcacggctcagtcctggtctcaagtgatccttctgcctcagcctccctaacagttgcgaccacaggcacgtgtcaccacacccagctaactaaacatttttttttttttagatatggggccttgctgtattgcccaggctggtcttgaacacctgggctcaagtgatcctcctgcctcaggctcccaaagtgctgggattacaggtatgccccactgcacctggctccctgttagttcttatttctctatttctaagtccctgagacagtacccactgtgggagatttttttttaattgtttccaaatattacccttccttatgggaggattatccttctcccatctcatcaacatcagacttggccatgtgacttgctttggctgccaataaaatgtaagaggaggtgatgtttgctacttttgagcagaaattttagaagtcatcatgtgattttttctcttctcccttctagcatgagaatgctttgaagtcaggcccaagcagcaacttcagctcaggtctcagaataaagacaaaatagagaggagatgcaatcaacctgtgttgattgaacaaaaatgtatctttgttgcaaaccactgagactcaggggttttttgttactgcatcattacttagtaaaaacagactgatacactctctgaataccaatatatttaagtgaaatgccaggactgttgtaaggataatatctttaatcaataagcatactcttaaataaccaataaactgtattatagcttatccaagaaatcttgcaatagagctttctgccctctgtgaatactttctatgcatctatccatctccatctcagaaggctaaaagatcataaacccttgcctagctcagtacacaccgagttcattcaccagctcaatatgtacaaagagaatcagaaagaacagatggagcagactaaatgttattttaggttccaggacattggatagaatgggagagaaaaaggatttattttctttcgtggatgggaattagtacaaaggcctgatgagactgtcccttatccaaggacagagaataaaagaactcttcaatgtaaattatccattccaagctttcgaccctgctgccatttttagttccgaatcgctcacttctctgagaggttgcaaacttatgacctatgaactgaatgtggcctgtggaagtcttttcacataccaaagaaaacactattctatgtgcggatgttcgaatcaaattgattgccaacaatcaaaatttgagatatttcaggttaaaaaaaatagttccagcttctcttaattgaaagccttggttacactgggcttaggaaacttcaactaaagttgagtagcagctgccttttaggctgggcatggtttccacggtccctacctctccctattgccttatactaggctcacttcacttatttatattcttttttttttttttgagacagaatctcgctttgtcgcccaggctggagtacagtggtgcgatctcggctcactgcaacctccacctcctgggttcaagcaattcccctgcctcagcctcctgagtagctgggattacaggcacacgccaccatgcccagctaatttttgtatttttagtagagacggggtttaaccatgttggtcaggatggtctcgaaatcctgaacttgtgatccgccctcctcggcctcctaaagtgctgggattacaggcgtgattatttgtattatttgcataatccatggagccacttgagtttgccaccttgagtatcaattaactcctttcctttcctttttcttgtccttcttttattcctatgtcttccacagtaaacaaggagatcttggggactccatttttgccactctgaggacatcactcttctgccttgtttttggaatttggggtgacccaaacttgacagtccagttctttggttcccaaagagcttcattctaaactatctattaggttggtgcaaaagtcattgcagtttttgccattaaaagtaatggccaacgggagcggtggctcatgcctgtaatcccaacactctgggaggccaaagcagacagatcacttgaggtcaggagttcgagaccagcctggcaaacatggtgaaacctcgtctctactaaaaacaccaaaaattagtcaggcatggtggtgcatgcctgtagtcccagctacttgggaggctgaggtgggaggatcacttgaacccaggaggcagaggttgcagtgagctgagactgcaccaactgccctacacgctgggtgacagagcaagactctgcctcaaaaaaaaaaaaaaaaaaaaaaaaagtaatggccaaaactgcaatgacttttgcaccaatcaaataagacaattctaggggtgcagggaagaaatgctttctgctggagattctgacaatgtttatctaacagcttctacaatacttggtgatttgcatacttgtgtagctagcaggtcttggagcagcataagcctcctgcctactagataattctgttgcttaacaaaccataacagctttgattacatggaaaatgctagcagtaaatgattggaaaatgattttactgttttctgttatggaaactcacatgtaggaacattatggaactgtcttgaaatttcttttgccttctaaatataaaatcactagactttgatatttcagcaattctacattttaaaatatcagagctgatgagatcgatactgctttgtagatacctacactgcagagagctagccagtgctatctggataaagtagacagtaggtaggcatttgcaagcctctctcacctacccctttctttttctgcaccagattcattgctatactgacctctcattgactgaaactttacatcaaggctcagggactgtaaacccaccgcagcttggaatatggaatatggatgttgagatacacacttcagttcctgaactcagtaatgaaatcgcccccagagttctcatgccagcattcagctagctgcaactttctcctgcttgccttctaaggagattaagaacgggcattttattttgtttccgttttagtttatttgaaggttttatgatgtcttggttgagtggctcgtgggacttgcaaataaacatgctgcctttaaaaatggcaagttgtttttatttatttcttttaggtgcccagtgacctccgggtatattaggcagctttaaattataattaaaataataactgtggtcctaaaacagtaatagatgttgaatgatacaaacaccaaattaggatgttcagaaaatctgtatgaaggaagccagagaaagcatggaattaaaaaaattatctttgtggcaggaccaaaggaaacttatctcaaacagcagctttgttataatgcttttgttttgttttgccttcctataaggctactcaaaattttttttgtatttgctagatttggggtattggggggtgggggaatatccagttctttagttgatcttgctatgactttgccgacagaaggaaataatgaaaattgcttgtcatcggagaaaatccctgtattctaatgatttcttgacaacttctgaagtccatgggcacaatcagtagaagccgacattgtgtttcactggatgccaaatcctcagagtgcttctgagtccctctaagacatacatctgcattcctccatctgtcatcttagttcatcttcctctcccaactgttcttaaattaaatgactacatctaatgggagattttctcgtgaaagcttatgagagtttgtctgaagacaaattaaaacattgcaatgtaatcacccagctccactctctgcttggctggccccagtgcctacttttacccaaagaagttaatcaacgtttgggccctgtatagagaaaagcaacaaggaaggaaatccattcaagaggagatggaatctacccgctgacggtcagagggtcaggggatgaagactggatctgtccgctgcagagagagctgtgagatatgccagggctctgaagaccagggcaagaagagtaggaggcagggagtgaaagaaaacaaacatctggttccagaatatcaaggcatgatgcttaaccccagggatataaaaattccccttctcttaccctccactccccatggatgagtggatgtcttcctgcagttgttacaggtcactagggttgatgggactcttcagcttggctagttattgccccctacttctttttttgagatagggtctcacttttgagatagggtctcactctgtcacccaggctggagtgcagtggcatgatcatggctcactgcagcctggactgcccaggctcaagtgatcctcccacctcagcctcccgagtagctgggaccacaggcacgcaccactatgcctggcttatttttgaaaactctttagtagagacagagtctcactgtgttgcccagcccggtctcaaactcctaggcttacgcaatcctcctgcctcggcctcccaaagggctgggattactggtgtgagccactgtgccctgcctggtcattgcccttttattctctcactgcaccatgtgaatccctttcaacatttggttgaaggggacagcatctccagcaattccgccttacagaaatttatcctaatgagacgagacagattcactaagcacaaagatgtccatcatttcattgtttacaacatcactgctcattaatagggaattagttaaataaacaatggtatatccaacactggaatgcaatgcagtcattgcaatgaaactatgaaaaatcatcaaaaattattgaaaatgtataacccactgacatggtatattgttgcagacagtatacatactatgataccactggcacgaaataaaacatatgtatatgtgcatgcataggagatatctgataggacgaagtccaggttaaccgtgtttacttctgggtggtggaatttttggcgattttaatttttatgctttgataaattgcttgcatttctcaagatattgtacattatcttttaatcagaaaaataaagcttaaagctaggtctatatttgagagaaaaaaagaacagccttggttaatggtatgtgagtcattacgctgttctcctaaagtctccaaacccaaaaatttcccaaggcattgaatcctgggaaagagctttggctgggtcatgatgggaacagggagttggctgccgccgtgatgctccaactctttattcccaggctacaacagtctaatttgataatcttttccattgaatctttatgctccctactaaacactcagagtgcttccttggatcaatgctttcaagttcatcctcatatcatctttgtaaggcagaggtaggtagggaatatgaagaaaagtttcaggacctgagacatcagtggctatgggacttgagggagaccatggtactgctgagactagcgtactggttctcaatctctcagctcagtgcttcttccacaaacccctagtgcttcactttcagaagtgagatggagccaggcatggtggctcacacctgtaatcccagcgccttgggaggccacggtgggagaatcgttgaggccacgagtttgagaccagcttgggcaacatagtgagaccttatctctacaaataatttgaaaattagctgggcatggtgggcacgtgcctgtattcccagctacttgggaggccgagttgggaaggattgcttaagtttgaggctgcagtgagctatgatcatgtcactacactccatcctgggagacagagtgaaaccctgtctcaaaaaaaaggtataaaataaaatgacctttttaataattcagtaaacgaaactaaaaccatccgtatcttgtgtagggatgttcaagagttggattataatctggctgtgatcaaagtgctcattaagaggaatatttttggacctctaatggctatcattggacctgattcatcctgatctgctgagacagtgctctcagggaagtctggagttcgggttaaaggtttcagttctactattaacagtggcaaacaaaggcaagggttaacctgactaggtctcaaccttttcatacctgaaacaaatggggaggccgggcgtggcggctcacacttgtaatcccagcactttgggaggccgaggtgggtggatcacttgaggtcaggagttcaagaccagcctggccaacatggcgtaaccctgtctactaaaaatacaaaaattatccagacgtggtggcaagtgcctatagtcccagctacttgggaggctgaggcaggagaatcaattgaacccgggaggtggaggttgcagtgagctgattgtgccactgcactccagcctgggtgacacagtaagactctgtcccaaaaacaacaaacaaacaagcaaaaaaacacgaatggggagagaaaccttggctttacactccccaaggcatcatttggaggatcaagtgatggaagagataagaagcccctctctttgacttctctctagccttctcaagagcagctggtcaccccaccccatagcataatcttgtaatatgctgccacttacactctacatcttgaggtttctgcctccccagtcgggctgtgaaagaacaaagtcaagaatgattctgattcaatataataccacgcctatgacctaatactgtagttttcaatagatgtttgccgactgggtgaatggttcagaaattcaaagtactccaccagtgaaataccttagagattgtatcagtgggaactcatggaactgtcttactctgaaatatacaatgtattacccatttaaaaaagctcacacgctttctgagattgttagagtatttggaatgacaaaagtagttgctgatatttgactgatcactttgtgccaagcactgtgctaatctctttaaataatttttttttttttttcagagacggggttttgctctgtcacccaggctggagtgcagtggctcgatcatagtttattatagcctcgaactcctgggctcaagggatactcccatctcagtctcccgagtagcagggactacagctgtgctccaccgtgtagggctaatttctaaattttttgttgagacagggtcttgctgtgttacccaggctggtctcaaactcctgggctcaagcgatcctcctgcctctgcctcccaaagcgttgggattacagacataaggcatcacatcatgctcagctaaataaattttctcatttaatcctaccaccctccctttgaggtaggtggcattatcattccagtttttcagattctgactctgaggctcaggaggtagtctgcccatgcagagaaagaataggtctggaagccactgcccagcctgtaatcttgatctctttcctgactgtgtgtctggagcagatttgcaacaaagagcagggtggtttaggacctgtttattttcattctaactcagggtttatactgagttggcttcttgcagatgctctttcaaccagcccctgttgagcaggtaaaactgaacaaggctgcgatgaaggctctgatgggctgcacatcatcaccctgccatctgacaatatcattcacctccagagcattagctcaaacatggtccctccctttgtttcttaaatgttcccattttcttttacttccccctctgtttcctcttaaccagctgagtgacagaaactcaatgctgaccacttcattagcccatgatgaccttgtgcctctggccttttgccctgcctgctctcctgggcaggttgccttacgtcataagtccttgttaaaggtcaggacctctgagccatcagcactgggcatgttgttttaatatatatctagagaaatcagggctgtcggatcacattaggtcctatttgcagactgcatgccaatacccgccgtagagaagaactgttacctttgaaatacaatcatggctagttaccagtgagtacagaggggggattatattccatcagtgaggcccttgtaatctgtttctccccccatcggcagggccacccttcttcctgtacagagaaaatccttataaacagtagtcacataaagcagtgaggctaagagatacattgtgtttttaaaaccagatgcgttaatgagtgcatgacgggtagtgtggaatgtgataagtcaatgccgcaggcgctggtgtgaattggcacaatgctctggggctagatgttgatatggtaataaaatgataaagttaacagctactattcattgaatgattataggcacaagactaagcattttatatgcactaccctgtttgagagtcataatatccttataggtcagatactactatgtccatttcatggatggagaaactgacgtccagaaaggcccagtgattggtccatattaacaaggccattaagtgatggggatgaaacggactccaaagctgctcctaatccccaggcttccatgattctgccaggatacaatttggtctcttctttcaggtggagttttaggtggtgcttaagtagaaccatattgccatttcccttctagggaggggcctcaaatatgtcacttgacccaacagattttttttttttaactgagtctgagaataagccaaccttgtttcccccctttcttctctaggattggtttaagctcattctcacatctcatgggagtctggttggacggatcccttgacggaggttagaaatagctctcatagcctatttttaaggaaagcatgacgttagaaaatgaggcagaaatggaccccgagaagagaagagaactcaccaggctagagaatagggtcaacttctaacgaagccttcaccaagaaatgctcagagacgagaagtgggaagattgacaaagataacattggcagagacatagtagggtgggtgaaattgcttttttcttcttccttcacccggacagcatatttctgtcacattcattgtgttttgcccacagaaagctcagccaggaaaggtaaatgctgttgtcttgcagcaaacccacttttctaactagagaaatacggcccgaaaaatgcacacagaaatgcctgcttatctctttcttgaaaccccaggcacactgcagaggtgtctagtaacactgcaatttcctttgaactgtttggttttgtttggtgtccttgtctggctggttagtcttttttgactgcgttaactcacctggtataacattttctttcattgagaaacaagaaagctggaactcacctctctaattccggcaaagctggacaccatccaatagcgctaggctagacttctgggggttgtaacttatatcttccgagctgaagaagaaaagaaaggacaaaaacacggttggggagatgtttggcaaaccttcgcaggccaagtggctaatgaatgattctcccattgcttttcacttatttttcttaaataagatttctttctagggtgagggtttattcaagtcacccccttgtcggccagtatcaaggcaaatgacacagttccctgtattcacttatgtttcctaggctatagaaaagcacattcttgaactgggaaaggcatttttaaaaatgaaactcagggcagccaacctcaagacagcatctgatattaattaaaaatcataaaacactctaagtcgaactaaagaaatattggtagcgggatcaggacaaggatgagggaaattgaaagtgaaatcttgtactcatggaattctcctggccaccgcatttctccccgtctatcccagggaaaggattcaaatggtgttaactactgaacacttgcctcgttttccattcctctttccctgggtagctgcggtgagttggctgccgagatgtagccctgaacctatccatcaagtctaaggaagagagagttagaaaggcaaacattatctggaatcaatatctttacaaatccaaaggaaaccccagctcccgaagggttaagccagggaaggaaaagccatcaggctgtttagtgagctaatgtttttattgatgggggaagcctttaagtccctaacaggaaaagtggggaaagtggcagattgtttggctggggagaaaggagacgggaaggaacattatacaccacgctgtgtcctactccacgtattcagacccctgaaacccaacgaatgcagaagacattccctaaccttgaataatattcaacccaaggtgttttcctctctcctacccgcccctccccgcaaagtggaatccacatcttcccctaacaacttggctataatgcacatctcttggctaatgcctgcactgaagagcatatcttaattgaacaactgtgttataaagcacatctcaagctgacattcctgggataatccatatttcaacctaactaccctggcataacacttcaatctaattcccccactgtaaagtacattgcaatctaacaccctcatataatgtacatttcagtccattattttgtattttgtaagccatattttgacacgtcttttccattaaggagcagaactgtctggtgacaacggctatccctgtgctgaaagcccccatggtttgtacatcgtcctgtggtgacaggctgctgatggacacgcttctgaactttcacctttgccatcttaggttcaactcgggcttgtttctgtacttcaagctcaagcctcctgttgggggagcaggggtgaccagagagccctgctcggtcctggccagctttctctcaagctgaccagcaggtcgggccacctcacatgatcaaagtcaggggtcagggtgtagccaatgtcagggtccaatgccaggggccaatgtcagggtcagaggtcagggtgtagctgctggctaatagagtgtcagctaacactgttgtcaaattgctgggctaaaagacaatggcagcctcctgcggaggaccttaccctggggggagggggcgattggctttattggaaacctgccagtctcagaggtgatggaagtggctgatcacagctaaagactgtttgattgttgatggagagccagttctgtggttggtccctaactgaaaggcctgcagagccgcttattgatgactgagttttccacttatgatggatttctcttctgtttcacatgcagctggatttccattcagtcatggaggtggattgcggtgacgcatggccacagacttttctggaactgagagctatgagaggtgataccgtcactgacttctgggaaggcaccaacctcgtattgtctgttgaatggggctgattggttcttgaaatgaaaccaatccagaatgaattgaaaaatagatataagaggtcctgcaagtccaagacagttcagcgaacataaaaagaaggcaatcaatgtgttctggaagagatttagtattctaactatcaatagcccagcctcaaattttccacctatctcaggcaggggaaagaaattagatttctttatctactggtggcatataaccaggctagtagtgccattaaatatttgatgaaaacgaggttacaaaactggaagaattccaaaatttcccaagatagtatgaatttaagagagacaaaaacaggaggaggaaaacaaagtatagagataaaaaatgatctgggccgggtgcggtgactcacgcctagaatcccagcactttgggaggctgagatgggcggatcacaaggtcaagagattgagatcatcctggccaacatggtgaaaccccgtctctactaaaaatacaaaaattaactgggcgtggtggcacatgcttgtagccacagctacttgggaggctgaggcaggaaaatcgcttcaacccgggaggcggaggttgcagtgagccgagatcgagccactgcactccagcctggtgacacagcgagactccatctcaaaagaaaaaaaaaaaagatcttctgaaaggcatacggaccatggaggatcagctaatacaaacccccaatgcagcctctgctaagacagacaataaacaactagaaagcatgaatgggagaacggcttgttgaaattgcaaggttattctcctcttgagttatgccttgagaaaaccatatgaacatggcagtactagttttttaaactcttttctttctttttattttttaattaattattattattattttttgagacagtgttttgctctgttgccaggctggagtgcagtgccacaatcctgcaaacttgacctcccaggctcaagcaatcctctcatctcagcctcccaaatagctgggactacaggcgccaccaccaagcccagctaatgtttttgtattttttgtagatgtggaatttcgccatgttgcccaggctggtctcgaactcctgggctcaagccatccacctgccttggccttccaaaagtgctagaattacagacgtgagccaccgtgcctggctggtagtactagttcttaagcctcttattaatagaagtagtaaaacatcctagggagaaaagtgaggttgggaaatgaactggaattgtttttcttggaaaagaacaggttaaaggtgacatcaatgaccttccactgtattccattgtaggataagccatgttgctttggccatgccaatatggtatgatggcatatggggagacgttggcatgactcgaggtactacttctacctctttaagcctgttttcttcattgttaaaggggatcatgccatccacccaacacaggtacaacggggatgaatttggatgtagaactgttagactgttagacaaattcaaccttcaaaacacagcagtttccttttgccttaaaccacagcctgaagcccgagcaacgtagccagactgcgtctctactgaaaaataaaaataagaataaaaaaattgggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccaccgcactccagcctgggcgacagagcgagactccgtctcaaaaaaaaaaaaaaaaaaaaaaaaaaaaattagccaggcatgatggtgtgtgcctgtagtcccagctattccggaggccgaggtgggcaaaccacttaagcccccaggagttccaggctgcagtgagccgtgatcatgccactgcactccagcctcggtgacagagcgagatcctctcccaaaaacaaaaataaaaaaacccatagcccgggcttttccatgatggacattgttaaatatgaggtgttggataatatatcttctctttgtgagcaagaaagtccagtatctatttagaaagtttaggcaaactctacttgaccacagggagctgacttagcccagagcttagcaagctatggctggcaggctaaattttgcccatggcccactattgtaaataaagttttattggaacgcagccacactcattcatttatgtattgtctatgattctttctgcaccacgacagcagagttgacttgttatgacagagacagcatggcttgtgaagcctaacatatttaccatttggccctttatagtaaacgtttgccagccctgacctacaacaatggaacactctttcctttgtttaaaactaaaatcttatgtggaaattcaatatgcaaagcaggttcaagaaacaaatatttccccaggaagctgaactcttccttgtttggcagaaataatctatggttggtagaaattctacagcaatttccatggttccatgcagcaatttgaaaactatgaactggataatctctggatacttctttaaggtcctagaaactcagtaatttcttcagagattaaagaatggccgcaaatgcgccttcgtctggcaaatgctgggctttttttttttttttttttttttttttttactattatctgtgtgatgttgggagggttactgaacttctctgtgcttccatttcctcattttaaaaataaagaaagttgggttgggcatggtggctcacgtctataatctcagcacttcaggaggctgaggcaggcagatcgcctgaggtcaggagttcaagatcagcctggccaacatggagaaaccctgtttctaataaaaatacaaaaattagtcaggtgtggtgccatgagcctgtagtcccagctactcaggaggctgaggcagtagaaccatttgaacctgggaggtggaggctgcagtgagcctagatggtaccgctgcactccagcctaggcgacagagcaagactccatctcaaaacaaaacaagaggatgattgtatttgcttcacaatttgttgtaagaattaaatgagattatatatatattttatatatatataaagtgctatatatataaatagagcacttaaaatagggcctggctcatagtgctcagtaaatgtcagcaattattgttgatattttatataattacattaatattatagactattatcaacagatattatactttattaataaatgccaatatattttactttatattatattttatcctattaattatattcatattgtcattactatattttatattatattataatattattttatattgacattacataatattatcagcagatattatactttattaatattaatgtcattaatataatattttgttatattaataaaaattattgttattaacatgtggggccttcattcatgctgtagagatcacttccatattattctaaatatccctaatgacatttccgcttattagttaattaattcagttggccactcactccacacatctgttgtgtgccaaagtaatcaggaaatgaaccaaagtccatgcgctaccagctgcacatctagtcctctcttgctcagtcattttcggcactttgcgttggtgtttattgctctacatcttctgcggcgtttcagagtgacaccactgctcaaaacaacttcctactactccgtctctgactgctccacaattaatttttcaactagcagtttggtttcaatgcttacaaagtaattagaccttaaaggctctttacctggattttatcctgtcagcgaatgtgaaagaaacaataattattatttaatatttattgtcttcattgtgctatgtagactcacagatgtaacctgccttattgttgaagatgacagcagagtgcaggcaggtgtgtctggagaagtagtcagaccgctttggaggcccaagttctcagatgcttccatctgacacctgcgcagtcaaaggacacattttgggttgagtggttcctaatttgttatccctaagttttcattttctacagtttgattccagaatggtcgtttccaaagatgacattcaatgatttcttgtaccaagcagacggagcttttgggggagttacattttccaccactgtcaacagaagagtagaacagacacaaccgcagatgctgctggatggaggctccaggcccctttggattcactcttcccccaccacagactggttcaggttgtccagaccaaggtgcataggggctggccagagtggtaggtggacaatgtcatctactggctgctaagaatgttatccctgtagtttggggctggtgtggctcagtaatcaaatgtgtgagcttctttgaagtaagatggccctgggttcaagtcctgctcctgccccttcccagcagatgacctttgccaagttacttcccactgtcagcctcagtgtgtcctcatcaataaatgaaagtaacaataactacctcacacattgttttgcatatcaaataaaataaatacacagcaagtggcagctgttgtaattatattattataatagaaaagaaatagaacccatagtttctgttttggagtgccttagaagataacaggatataaacataaaagcatgaaatcaccttgaaaaacatttacacgtcttcatctatataatgtaaactaaaagagtagttaaaagccaggggtatcagagtgactggtggacatgatttgctctcatgatttggtgtaaataaattgcaaactcccggatgacagagcctgtatacatctttgtatctccagcactttctagcaaagaatcttgtacattttaacccttaacatgtgtctgttgaactaagttgaactggatttctttgtaaattcagtagaattctaccaaaaataatcactggcacaactcaagtgtgcgcgcagataagaaacatgaatacagtgttgaaaccggcatcactcaaacaaaaacaaaacaggaagtcttacacagaatgggcaatattatttggcaataaaaaggaataaatgaatgctaccatgtagaagaaccttgaaatcatgctaaatgaaagaagccagtcacaaaaaaccacacactgaatgattctatttatatcaaatgtccacaacacaaaaattcatagagacagaaaatagatgagtgattgctaagggcgaccaaatccccaacttttttgcatatctgtattgtatataatttctataatgaatttatattactttggaaggaggtaaatgttattaaaataaaacgtacaacacaaaaagtggtgagggacatggagggaaggggagacttggttactgaggtcaggcatctcagaggggaaaggaaggtgtgtgggggttggagaaggcttcctcgttgggaaaggaatgttgcatgtagagaacagcattctgtagcaggaatgaaagggggaaccagtcagaggcaggttggaggaaggccttgaggaactgtgagaaggatctgggtctgatatcaggatacagaggctgcctcctgctcggtgggaaagaatgtcgtgattgattggtgatacctgcccgggcataggaatggcagtgatgaatcaatgccacacactttctactcctccaggagccttcattctgcaggtgcccgagaaataaaaacacatttaggtctgtcctacgtgttgaggtctgacgaagtagagttggagatctaatctgaattcctctaaattcccatgaaaatattccaatctccatgggttccttgagtcaaattcaggaagaattcacgtgataacactgaccttgccgggggctacacaaagaaaagtgaactttctatttccagcattatatcagttaaaagaagaatgcaaaaaacaaaaaaaaaaaaaaagagagaaagaaagaaaagacccacccccaccccacccacacagaaaaaaacagaaaaggagaggggcggagaagagagctgggaagggggtttggaacctctgggccctatcagttactgagaagccactctgtggaggagacacgcaagcttccatccctaagacatttccctcactccaacaagatattttcagtacatcccaggcaccaaataactgctcatatgtcccgaacgatgatgaattcattcaaacaacaagtcaagaccctggatatcactcaactccagtcagtcataacagctgacaaataaaaaatataatatacagcctgttagttctgcttttcctcatcttcaatatgcagattcaagaatcgcattctattcccagctgtcagagacggtgacagttgtggggagttttctagctttatcaaggaagattatttttaacccaaattattttccattgtcaatgtttaaatccatattaagtccagattaatgcaggaagtagcttcaaaggatattgactgagggagaaataataataaatgaaattattaaggacagggcccatttcaaggaacattttcagagtagaaaagaaagttgtttagatttaaatgataactaaagaaaatatgtttcttagggattgctggctcttttcacaaacacccaaactttgtatacaaactaggggcctgtagcatttttctttctttttttttttctcacgtgattggaattaataatgcagataaatcctaaataaatcaggattagtgttaaccacatcttgaggtttaggatgctataggaaaatgaaaagagagagagagaaaaaaaatgagttgcttaaaaaaaaaaaaaaaagccctggcctgggctaccggggtgaggaggggagagaagggggctggggggaagggaggggagtaatcgcgagaagagagggccagctgagccgggtaatcaaagcccttctaatcgctgcagctctggagatgtgttcaaaggctctttcctgaccacaggctgagccgggtcacaagtgaaatgcagttgctgtgaagggggaggggtgtctggaatttttggatggttttgctatcaggctttgttaggaggaggtcagctgggttgtcagattttagcatctcctcaggaagcaggttaaactctctggttgttagggagagaccctctcctacccctccagccccaccaccccaaaccacttgccaaaccagtgaagaaagggaacatggaagcctggatgttcattcccacctggaaagtttctcccagagctctcaactttggatgtaagaatcatcttcgataaataattgcaccttgggatgaattttgtaatttaagtttattttatgtttttagagacaaggtgtctccctacgttgcctaggctgatctcaaactccggctcaaagactcaaagaagcctcctgcctccgtctcccaaagtgctgggattacagccacacctagccttggggtgaattttaatgaagccctttagatccttgatatttttctgcactggagtcattgaaaatggcctcaacacattaactccaggttctgtccccttccttcccttgtgtgagccctaaaggctgcaggtgaggaagacttgggtcctttccctctggtcaccattacgggctttaattttcagtaaataaatatctcttaagtttaagggaagaaataagcactctttttttattttattttattttttgagatggggtctagtcctgtcgccaggctggagtgcagtggcgtgatctcggttcactgcaacctccacctcccgggttcaagcagttctcctgcctcagcctcctgagtagctgggactaaaggcgcacaccactacacccagctaatttttgtatttttagtagagtcggggtttcaccatgttggccaggatgaaattattaaggacaggccttaataatttaattattaataattaaggacaaggatggtcttcatctcttgacctcatgatccgcccgccccagcctcccaaagtgctgggattacaggtgtgagccacggcgcctggcctcaaaacaagcattcttaaccccaaatcacacgtctgcagagattctggctgtcaacgtgatgctggggtgaaggcgaccattgcgaaaatgtgcaatctttggtcggcatctcagtccagatggactcagtgattgtcttgctttctcacttcccttgggtattgcagaactgcagcccctgggatttggcatccacgtgacatggctccttgctgaggcctgcttccgatggcctttcttcggtcaatgcacagatctcagtgttgtcttaatcttcaagcaaccaggctggtctgaagtttttcagaagttttggagtttggagagatcatgtctcccatctgtttcctgttccgtttttctgtacttcctcttctttctcctgcaccagtgactgggcacaggcggccactggacagtcactccctgtctgcaataaccagagtctctactgatgattccgttatccttgcaggtctgtcactcagtctcccccaagacacactaaaatggaaagaaatgaatgacttgggggtgggcggcttttcttgcagcccaggatgaagctctttcacaatcctcagggcatttgtggtgactctgcagtaggtttaagtccagagaatgcaacatacattttagggactcttgatagttactatggtaatttgaggctttgaaaaatagaaatatgttctggggaaaaagtggacattacatcagatgcaaaatgctcaaccttcaagagcttcatactactaaagatgggtgaagaaaggaggagatgtttgtggtgaaggccattaaaaaaatcaaaagcaaagattgtgaaaataaacaagcataaattggattccagcataaagataaagaaagatatttttgggattacaggtggtggctcacgtctgtaatcctagcactttgagaggctgaggtgggaggatcacttgagcccaggagttcgagaccagcctggccaacaaggcgaaaccccatctctactaaaaatacaaaaattagcttggcatggtggctgcacttgtagtgccagctactcagaggttgaggcacaagaatcgcttgaatgtgggaggcagaggttgcaagtgagctaagattgggccattgcacttcagcctgggtgacagagtgagactctgtctcaaaaaaacaaaaaaaaaaaaaacaaaaaaaaggaaaaaataaaaagatttttttttcagttggcatgtatactctgaatagtttcacttgatctaccaaaccaaaatagcacatgcttaaaggtaaataattcttagggctttaggcttcagtagtcaatataaaggatgttggtcctacatgaagctaggggcaactcccagacagcaaggatcttgttgcccaagaggaaacagagtggaaattcagcccttgccccaatccctcagctttccatggaagtggaacagccaatggtgacaaaatacagcacattttaaacaagtgctagtgatataatgacacaatgatataataatatatatgaagcctggacacagtggctcatgcctataatcccagcactttgggaggctgtggtgggtggatcacctgaggtcaggagttccagaccagcctggccaatgtggtgaaacaccgtctctactaaaaattaaaaaattagctgggcatggcggcatgcgcatgtaaccccagctactcgggaggctgaggcaggagaatcgcttgaacccaggaggcggaggtcacagtgagccgagatcgcgccattgcactccagcctgggcgacaagagagaaactctgcctcaaaacaaacaaacaaacaaactacatgtatatatgtatatatatatgacacatgtcattatatatagtacatatgcatatcatacacactcacatatatgttatatatgtaagaatatatataaagtggtcgggtgtggtagctcacgcctgtaatctcagcactttgggaggccgagatgggcggatcacaaggtcaggagatcgagatcatcctggctaacacggtgaaaccccatctctactaaaaatacaaaaaattagccgggtgtggtggcggatgcctgtagtcccagctacttgggaggctgaggcaagagaatggtgtgaacccgggaggcagagcttgcagtgagccaagggcgcaccactgcactccagcctgggcgacagagtgagactccctctcaaaaaaaaaaaaaaaaaaaagactatatataaagtgttcttttccagtaacacaaaagtcaggcttattataagaactagctgataggtgggtgagtagttcccattaaaaaaaatgatttgaggtacttaaagaaaactgtggtttttaaaaaagatgatcattacagacaatggggtagattgcaaagcagactgaaatggatcttcagagaactgctaccatggatccgtcatcatttcaagaagacatctcccaaacaggtagggctctcttaaactaagccttcgctcctggtcttgctttgtataagagatgtttcttttaatttaatttaatttttagacagggtctcactctgtcacacaagctgcagtgcagtggggtgatcctggctctctgcagcctcgacctcctgggttcaagtgatcctcccactttagtctcccaagtagctgggactataggcacacatcaccatgtctggctaatttttttttttttgaagagtctagctctgtcaccaggctggagtgcaatggtgtgatcttggctcactgcaaccttcgcttcctgggttcaagtgattctcctgccttagcctcccgagtagctgggattacaggcacgtgccgccacgcccagctaatttatatatttttagcagagatgggctttcaccatgttggccaggatggtctctatctcctgacctcgtgatctgcccacctcggcctcccaaagtgcttggattgcaggcgtgagccaccgtgcccggcctcctggcttattttttaatttttttgtagagacgagttctcactatattgcccgggatataagccacgtttctaaagcgcactcagatgtgcctgcctctgaagtctagccacccacaggagggaggacaagtcatgaatgtggtcatttgaaggccccaaagggctgtctcctttagttccctttccttacccagcagatggtacagagtagctccaggtatgtttgggtagatggtgcctcttaagtcctgggttttccgtgacagttgttccctcaaataccctctgccatacttaaaccttgcatcagctcagctatcagacacggacttgtgttgtggaaacaatggtctctgtggcccaatcagacatcgggcttgccacaggttaacttcattcttggctatgatcaatgtggagaaattgtcctgggtgatttaggaatgtttggtaaaaaaaaaaaaaaaaaaggccagtccacgatagacattttatctgaaagatataataattatgccatttttcagctcctccttaaaaaagggggtcgagtcactatcccttagcagttcattgtttccaatttggcttaattgaaactgagaaagttcttaaagtttgaacagcagtaattaaatctgaattggatgggatatttgtaattttgaatgcttaaattttgagaggaaaaaactgtgtaatgttgttggccaaatgaccccagtcattaagattcctatggcattatttagttagttggctttttataacgccacgaggtttgctgtgggctgccatggacgccattggcctcacaaggagaagaagcattttagagaagagcctctgagagagagaagcagccccttaagagtctgctaataattggcattagcatttctggacttctcgggatgcaggaactgagatgagttgaggaaaatgaacagaagtgacagtttttgtgaggccaatggaaaccatgtttggatccaggaaaaaaaaaatgagacaggaaagggagggtcacatttttggaggaaatcatgtggtattttggtaatcctttgttgatgaaaaaaattaccagcacattaattatgtcctaagaatgggacactgcaggtctgcatctttgttctttcccaggctgggacagcagccccggcatttaccactctggggattagaaacctgggttcctggacacataccatgagtacctcgctacagtgttgaaatctaacccagccaggagttcaggagataggaggctttttttcaagacaagtaatgacaactgaatagtttaaaatctttataagactggtagtattctgccagtgcaaagtaataaaactaaatatgacatgaaagtccttttcttttctttccttttctttctcgctcccttccttcttctcttcccttccttccccctcccttctcttttctcttctttcttttaaaaacttttttttatcagttatatacacttgtaaacgtttttcacaagagttcaaacatttacatttagacatatacagcataaaccaacattgacccttattcttctagattctttaggtaggattgagtacatcgttgccactcataagcaaaaagcacgaagctggaggcatcatgctatctgacttcaaagtacactacagagctacagtagccaaaacagcatggtactggtacaaaaacagacacatagacgaatggaacagaatagagagcccagaaataagactgcacaaccacaaccatctgatctttggcaaagctgacaaaaacaagcaaataggaaaggactccctattcaataaacagtgctgggataactgactagccatatgcagaagattgaaactggatcccttccttaaatcatatgcaaaaatcaactcaagatggattaaagacttaaatgtaaaactcaaaaccatgaaaaccctggaagacaacctaggcagtaccactctggacataggaacaggcaaagatttcatgaggaagatgccaaaagcaattgcaacaaaagcaaaaattgacaaatgagatctaattgaactaaagagcatctgcacaacaaaagaaactgtcaacagagtacacagacaacctacagaatgggagaaaatgtttgcaaactgtgcatctgacaaagatctaatatccagcatctataaggaacttaaacaaacaaatttacaagataattaccacttcctttagaagaacgtgatatattagatgtacattgccattgtggtaaaaatggtcacgcatttttctcccctttttatctaagtccttgggtggtgccctctcacagactctggtctggccatatgactttttttcggccaatgggaggatagctaaggtgacacaaacccaaactggaaaagtatgtgtgcaccagggcttgctatcttgctgtcctttggagccctgaggccaccatgtgaagaagcttggggttgcctgctgagaaataaggaaccacttcagctgacacggagcctactccaggccaccaaagggaggccattcttgtttatccatctcggtcaagccaactcagactcggagaatggcccagcttccccaagaattgtgagaaataattgattgttttaagttactaagtgttgggatactttgttattatggcaaaagctgcataataagccataaccaaagttgttatttttgtcctttaagctcgattattatattatcattattattttttgatatagagtcttgctctgtcactcaggctggagtgcagtggcatgatctcggctcattgcaacctccacctcccaggttcaagcgattctcctgcctcagcctcccgagtagctgggactgcaggtgcgtgccaccatgcctggctaatttttgtatttttagtagagatggggttttgccatgttgaccaggtgggtctcgaactcctgacctcaagtggtccgcctgtcttggcctcctaaagtgctgggattacaggcatgagcctccacgcccggcctaagctagattattagggacttctttccttaaatataaggcattgtttggatatgtgatgattagctgttatgcaatggcagtgctccctttctgggtaagagcattgttccctttccttatccaaactagaaaacctagaaaatgtggataaatttctggacacatgtacccttctgatgctgaagcaggaagaaattgattccctgaaaagaccaacaatgagctccaaaactgaatcagtaataaatagcccgtcaaccaaaaaaagccaaggaccttatgagtcttcctgagtagggagtatggtgatttgcaaaggttgtttctagcatgttgatgaccttctttcacaggaagcagtgtttctcattctagctatcctgagcaaatttctaaggatgagaactccacacccacacagggcttagcaggtgtagttttctgtcccctttttttttcctaccccacagtcacgttttctaaactctgagcctccctccatctacatagagggtttaaccctccttccatctgcatttccctcattactgccatcataatcacattccttaattgcttggttcaaggtagcatctttcttaccatgagtgcaagaaagaaaagatatttggattgctttaccctttcaagcaaaataggaatcctgtcacggcatgcttatcatgcttattcttttcttttctcttctttttttttttttttttttagacaggatttacaagataattaccgtttcctttagaggtacataatatattagatgtacactgctgtggtggtaaaaatggtcacacatttttctccccttttaatctacattcttgggtggtgccctctcacagacactctggtctggctataactttctttggccaatgggttgatagctaaggtgacacaaggcctttagaggtactggctctgtcacccaggctggagtgcagtggtaccatctgagctcactgcaacctccatatcccaggctcaagcgattctcctgcctcagcctcccgagtagctgggactacaggcgcccggcaccatgcctggctaatcttttaaacatttttttgtagagatggggtctccctatattgcccaggttggtcttgaactcctgggctcaagcaatcctgtctcagcctcccaaacttctaggatcacaggtgtgagccaccgccctgcccacagtcactttctaaagttagacctgaatgacccctctccttcataaagtcgtctccaaccacctcggatcatggagctgctttgctcttctgaattcttacagccttagagtctcagtcgctcaacggttattgatcacattccacgtgcatgctcatttatcatactgtcttcagacttgattatgtgctatttgtggaagggattatatgtctttgtgcctccaaagtgcctagcagagggcattgtttaaggttggtgctcagtagacatttggcactgcactggtttccaacctttgctagcagcatttctcaaagtgtggtttgtgtattcctgcattagcatgatgagaagtgcttgttaaacactgtctcaccacctctcggccccttctaagacctactgagtttgcctttctgctaggaaggcccaggaatctgcacggtaaacaagctgtgcaggtcatttttaggttcataaaaatgtgagaatccttcttttctgcagtgggcaaatttaatccataggtggcctgttggaccccttacttctttatgcaaaacctagggatcctagacttactgaaacttctagaactcagaattgtgactttcaactgagaagaagaggggtgtgtctctaagaaacagggtttgaaaggtatcatttgagataataatatgatttatacttgggaacagcccattgttataatgatacaagctacaggcaagtggagaatgaccaaatctcagttggtgtgatgcataaagaatgctgaatggttagcttaatgactttatagagcaggggtccccagcccctggggcacagaccagtatcaattcatggcctcttaggaaccaagccacacagcaggagttgagcaacaggtcagtgagcaaaggttcgtctgtatttacagctgttccccatcgctttcattaccgcctgagctctgcctcctgccagactgcagtggtattggattgttatagcagcacaaaccctactgtgaactgcacatgcgagggatctaggttgcacactcttcatgagaatctaatgcccaatgatctgtcactgtctcccatcacccccacatgggactctttggctgcaggaaaacaagttcagagctcccactgattctacatgatggtgagttgtagaattatttcattatatattccaatgtaataattatagaaataaagcacacaataaatgtaatgtaatgcataaaatgattctacgtgatggtgagctgtagaattatttcattatgtattccaatgtcataattatagaaataaagcacacagtaaatgtaatgcaccacacccggctaatttttgtattgttttgtagagatgaggtttcaccatgttgcccaggctggtcttgaactcctgggctcaagcaatctgcccaccgtggcctcccaaagtgctgggattacaggcttaaccactcttaaccccggaatgtcgaattttccacaaataaaaatatttattttcaggtaaatctaaatgagaaacaaaagggaaattcttctaaactcaaggataatgatgaaagagttgtctctaaagaatggtggtcatctgtgaattcagaattctaactacgtcctcagaaaagagtcaggctacccatgctgctggtcttatatggcatgattcatccacggagctcagattccaggaacatgtggtcttcaggtgttttctgtagcttttccctcaggatttgatagtgattggtaggcagcatttttcctgtactgatgtctttgacacatagatggccatctttcattcagtcgggacaacacatgtattttttctagtttaactctgcctggcttgattgcctaagtccatctattcacaataaatatacaattgtcccatgagacagcttaatgcaataagcacatactgagccaggtgcagggattcggagacctgggggatagggtattctaaagacctaacaatgagtcctgtctccaaggttctgacagtctaatcaggtagacaaaatataaaggcactgggaaagggacttaataacaaaaccaggctgcagattaggggctacaagctggggctcacaggccaaatccagcccgtgacttgtttttgtaaataaagttttattggaactcagccatgtccattctttgatgtattctctatgatgcttctgtgctacaaaagcacagttgagagtagttgcaacagagacagtatggcctgcaaaaacgaaaatatttgctctctcgacctttatagaaaaagtctgctgactcttggaagtggatgattaaatactaaagcaagtgaaaggacaatagtaagtggactaacagttcagaagagtgcacgtttcctgcaatgtttgtgtgtgtatgtgagggggtagctttttagaggaagtgaggaattagagaaaagtagaacttggacaaagagatgagagagatggaataatccaagggtatttggtaactttccatatcaatattttacataaataaataaataaaaatactactgttaattttaaggtagattatttaactgaagctgtatgtttaataataacattatatttccaaacactttcactctctttcttgcttgccatagtcttgtgaggtaggcagggtagtaaattaccccagtttggcagatgaccgtcagagaggttggttaaaagcctggctgtaggtggaaagccttgtagagctgctgagccgatcctgcaactgccgcaaggttctgatttttatagggagcccacaggagaacttggcaatttgtgactatgtgcagcagatgaaacaataagaaatttgaaactaaatccttttattaatttttataccaatttttccatttcctgaatctctctgtccttcaataatgctaggctgtgagaagctgagtcatgcatgggttgactgtgggtctggatataaggctatgtttaaatcctgcaaagcaaagagaagcccaaagacatggatgtgcttgtcactcatcctcttgaaagcctgagcatctcagatctttcaaggaccagctcatctcccaaaaacaatgtggctgatgcccttaggaaatgtggggccgggcatggtggctcacacttgtaatcccagcactttgggaggccaaggcgggtggatcacttgaggccaggagtttaagaccagcctgaccaacatggggatatcctgtctccactaaaagtacaaaaactagccaggcgcagtggcatatgcctgtaatctcagctactcaggaggctgaggcaggagaatggcttgaaccggggaggcagaggctgcagtgacctgagattgcaccactgcactccagcctgggtgacaaagtgagactctgttgaaaaaaaaaaaaaaaaaagacaatttggaacccacaccatctatttggctattgccaacacttcctgaaggctttgccatggaccaagcattctcattaatgctttatgtgtttaatcctcacaatgacttcaagaagtaggtactattatgtacctattacacagatgaggcaaatgagttgcaaggagttcacccacttgaggttagacagctaatgaatgtctgagtcaagattcgaatccaggtcagaacttgcatccttatttactgcattcttccatactgccactcattgacaagcatggggatgcataattttgaatcatgctcaagaagtttggaaccaaaagatgctatgcataaactgcacaggaaacgtccatgctctttgacatgacgaggtcagatttagaaagctgtgaacatggacctcaaaaaatcctaccaggttctcagtcttacagatttctcagagggaacacagggagggcaggaggaatgcaaggtccaagctggaattaccccaacccggatgcaaaacacgccggcagctgggaggaaaaattggactaagttagtatatttggggacaaaggtggaagaggctcaagcgcagaaaatgtttcaacaggactccaaggaggtcttgtacgattatgctcaagcctctgggttcttaacataccacactttgccccacttcaatcagctgcaaggaaccccatccacactctgcctgggccccgcctgtggcaatgtgtctttgctgtggcttcattctggagttgttgcggaggaatcagatattggcagaataaaatggcaaacttggtctatggaaaatgtaaccagacacagaaagtggaccgagcccacctttgtcagcgtggcctgagtcaatcccattaacttcaagtcagtggactagactcagaaaatggcaaatcgctggagtcttttctccctacccctccccaccaaagcaagagcctagctgtggggtagagtacgtgttccattacgtctcttgggctactcttacgagctggcccctctaaagaataagtttggggaataaaaataactacctgggatatcaaagaaaaagaagccctgggtaagtgaaccaggcaattcccaacaatgacatggatagtagagttgaaggtagtaattatattttgtaccaaattgggggataatatagaagagcacaggacaattcagaatgcctggaatacattacgactgtgggcctaataacaggtttatgtaatttaatgagcagaaatatgaactataaaaccaggaggataaactgagaaacaagaatactcctggagggcttgggatgggcttttaaaagatgtggcagatattctccccaaattaggggcaatatagagagtcgcattggacctaagtaaattattcactcctgtgtagcagatttttaaggctttatctcaaagctgggttcagcttgagccacctattataaaatacaaatggatatgtgaaaatggtcagaaacccatgccagaaattggtgtgacatggagatttatggggcttcatacaccagtgttatgaactgcctggtctgtggccctctaaaaggaagagattccgagtcgggtttggacaaacagagacaaatcaagaaggaagctgggaacagttgcaatgagattttttagaatgatggctcaagtataaagaacttgaacctggcaggcatttggataacatttctggatgctttaaggaagttatggctagacgaagccaccaagagagcagtcaactcagctcaaccaatggaaagagagaagcaaggaagggccggattgggcaagagcacggggcagcattcactgggagagaggcagggagggggtctgctgcatggttacccttgtcaggttaatttcctgtgtgctccctctgatttgggggaaactcaaggaggatgttttctccttcaaacatttgaaaagctatttttagctgtttttaggaaggcaggaacaagagcattcctctctcaaaccgcaagaaaccttcatgaatatggccagaaattgaaagtaaatttgttattacgttgcttaagtgatttgagccttttcagagtcacctgaggaccctccagacagggaaaatcttgatgagataaaagtgccatctgaacaaagtgcatcagaatgttgcattccttaatgtcattgacaacacaacacgacacaacacaacacacagcatcctcctcatgatttccccgaatgagatcagtttgataaattagctccaaactatagccacagtcccttgcccattggaagagtttctaatagctgttctgttctctgccctgcaaagatgataatctgaggttcctcagctgttggatggttaatgttttgttcttgtacttattgcaaaattggggaaaagaaaaactggctttgtaactgtattggccttgagatttacctgataaacaacactgagtaataggattggaaattctcttaaaattttttgcacattatttggttacagtttccatatggcaagaaggcaaggggagaaacttccattctggaccagcccccctccctcccagccacacgtttaatccatgtgcttatgtcaaacttaattacaggacttttggcataaaataacagtccacatcctcagagagaagaacttaagcagttaatatgtgcgattgagtgaaattgctttgctgaatgtttatgagtaacccaagactagtgaaatgtgctgatattttaactgtttcagtgctgaacttgtgccaagatgctgtgaaatagaaaaaaaataataataatttcttccgatctgctgtgtatcatatttcttgaaactgagaacgttgggtaagacaattttatggctctttcacaaatagctttgtggagaaaaaaacaataaagctagaacaattatggaacttgtcaccagctcagggaactgcagagattcaagagaagaatagcaacttcaaactaacatccttttctgcagaaaattctcttgaatattagaggtccccaccaggggcaacaatttttgccttcggattttcacctacccgcttgaaccttttcagacacttctgtttcccattcatccccagtctaatgtgaatggttttaaaatgtagagatttccaaccctaaaacgactcgatgcttcccactgtcatctttgctgaaataaattcctacctctgtttaaatgttcttttgtctaaattgttcacagttagacctgctccttttagctctagaagaacctcttacaatataaaatcatctgcttattttccttccttttctaatgctctttcttatactagtgagatgtagagctacttctgaattcatagttcttttcattacttttgtttcaaaagacttctctattatcacctgccccataaatgccagccttttaacactatagtttcttttgttttctttctttctttctttctttctttctttctttctttctttctttctttctttctttctttctttcgagacaaagtctcactctgtcatccacgctggagtgcagtggtgtgatcatagttcactgcagacttgaactcctggactcaagagattctcctgcctcagcatccagagtagctaggactacaggagtgcctggctaagttaaaacttgttttgttgtagaaatgcagacttgctgtcttgcccaggctggttttgaactcctggcctcaagcaggtctcctaccccagcctcccgtagtgctgggattgcaggtgtgagccactgtacctggtccagcattactgttttggaagcttctctgtacctaaatgttctactgagcccaaattctcttctctccattctctccaaacccacattgtccctccccgcaattcccccaatctgtccccagactgttgggaatgtattcagcacttgttccaagggcaacagaatacaaatgtatcatctccatccacaaaacactctgtgcaccatctcaggatctccagctagctgccctctgggtttcagcaataccgaccgtccactccgctttacacctctgctccctttcaagtcacctccttgtccacatctatgacccttgagagcatggcaccctttagttttgctgactgccatcttcccttgctacttcaaaatgcttctgaaaatgcattttctcccttatctgcgactccaaacttcattcagcttatatttcagaattatttttagaactattgtttggttcagcatattagaatcctatctttgagaaaggtgcaataaggttagggtgttgaaattggaggatatttgtgagggtacctggcacatgcctggtacatagaagacacctactaaagttcacttatttgttcattgataccttcatttgttcaatgcatattgaatgcctaatacataaaacgattacatggtaacaatgccttgagtcatgctaggtggtggggattcagatatgagagatttgctgaaatagactaagggcatactctgaacttttcctacatttcaagcagagctaaccaacaatctagaatgttggtattatgaatctcttgtattatttttaatgcaggttataaatatgtaggcctgaaagtcatatctcatggtatgacctcacggtatgactttcacttctgggcagtatctgggcaacatggtgaaaccccgtctctactaaaatccaaaaaaattagctgggtgtggtggcgtgtgcctgtaatcccagctactcaggaggctgagtcaggagaatcacttgaacctgggaggcagaggttgcagcgaggcagaggttgcagtgagccaagattgtgccactgcactccagcctgggcgacagagtgagacgatgtctcaaaaaaggaaaaaaaaaaaaaagtaactagtgagggaaatcttcttttggcatagaagtgaaatatttcagtaaagtatcaaggttatgcccagtatggtggagacgcatggattcttgatattaatggatgacagacattctttgcctacctctagtaatccttcaggtcttagatcaaagctgttttttcttgaggggggctttctctgacccacccaattgtaaattaggtacccctgttgtaggttctctcctactctgtactcttcctttgctgcatttattacaattggtagttgcatatttattgtgtgattatccattgaatgtctgtctcccttaggacactgtaagctccatggaggcaggggccatatccattctgttcaatactcaatacccaatctccagcacagcacctggcacatggtaggcactcagtaacacttgtgggatgattattaatgtcctgatgctaactgcgaaagtgcagacagtccataaattgttcatttactttggaatcagctgtgtaactttttgaagcatcttcctttcactagtttttttttttttttttttttttttgagacatagctccactttgtcacccacgttggagtgcagtgccacgatctcggctcactgcaacctccacctcccgggttcaaacgattctcatgcctcagcctcctgagtagctgggactacagtcacatgtcaccagacccagctaatttgtttattttggtagagacagggtttcaacatgtaggctaggctggtctcgaactcctgacctcaggtgatccgcctgcctcggcctctcaaagtgctgggattacaggagtgagccaccgtgcccagccctcactagttactctgatgcaggttattgttgaaatagtttgggtgttcactggccagctgggaagaagcggacagaaacagttgcttgctttttgcccccaggacagctttgctgatggggctggcagaagatatgctgagctaggaaaggtcaaatcatcagagagtctgggaggtgggaaaagctggacaaaggaaaagaatgacctcgggatcttcctgtctgtacttcctgtctccccaggaagtgtcagtcagagattttcaggaaagggtgttgtcatggaaacctgaattggctcttcccctccaggctgtatggggacaagtgccctcatgtgccccagctgtccccaggcttgtggaagagggcagtcagtttgagttttccgacgcaccgtggaaaatccagagccgacaatgtctgggactacagaaccggcgacagcgtgcggcagggattcaagtccagaatgcggtggaacctgttatgaactaattaaaatttaatctgctaaagccattttctccatcatttgggaaccctctcttgacttcagcaagttccaaagagcctctcaaatagaggatgctgtatttttgcactttttttctctgtgtattagatttcatccccccaaaaaagccctttttaaaaagggattctagatagagtagccatataatttatcatccaaactgggacgcttttgagagtgaaaagaagtgctattaataattactctgggataatagatacaaactgggctgttccggggaaatgccgaggtatcttcaaggaaactgtagggtcaggcaccgatcaaatgcatccactgggctgaaagcctcaggcagaaggagctctgtctgtgtgactcttgtgccttggatagtgcttggtctacagtgaatgtgtaaatccacagttgtcctgggtgtgccttctgaacagaaaatggcggggggggcggggtggggggcgggcagagtgaacccagacgttccttgcaatttcacagccgcaaaggggaatctgtgttcctgcagcgcaggcaggtacacgatgcataagcgtctgtgtattctgtgtttactgattcctaactgttagcagttaattgccatctgttgacacaccctgagggggaatgttaagcagttctcgacatctgcatatatattctctgcctacatattttactaactcttgtttatgggacccatttcctcaaatccatgctactgtgcccctgattttgtaacatacacgtacccggtgtcaacctttggggttgaatgggcaaaaatgccctcctcaactgttcccaacacaaagaaatactaaatgcttgagatgatggctaccctaaataccctaatttgatcattacacattatatcaaaatatcacacctaccccatcaatatgcacaatgattatgtatcaataaaaaaatgggaaaaaattcccttttgggtccgccagagatgctgactgcagaccgggtcctgcccagactcgccagccactccatttcccacccctcctccacccgcctgccgggtccttcaggaagagtgaaatggtccattgatccctgaggaggaaaagagcatgttcggccttttgagaggttatggacactctgagtgacacccgagcccaagcctccaacagcaagtccggcagccccggggtgcaggggcgaggcccggccttgtctctgccatccacgtgtaatctggccctgaaactgaccagctccgacgccctccttcctcctgcccgccaggcgcttcgtgttcttcccatgtcttgggagagatccgtctcctttgacagactcaagattccaggccgaactttcccatgccaccgtccctcaaaatagccccagccgagctgtatttatagccgtgtgagactctaatgggccaatttgtttgaatttccactgcttttgtgttgaacttacccctctcctgtgggcagtctcttcaggcctttattgatggggtgtgtgaggatggcgtaggccgtgttcaagatggtagctctatagagcgtgggggctgttttgcatatttactgttctttaaagccggttttttgagagagagaaagagacagagaaagaggtttctgtaagtagcccggacaatgagaacaagaccggctgtatgccaagcacgggatcccggccaaaacacatatcattagcttggaccagctataagcaaggaaatgagaaacatatgctaggagcaaggttaggagtgaaggaccatgggtcattgacagtcgccctaaaacttttcccttgttcttcagctgtggcctggcggtgtcaaatgtcatttcgactgccttgatttctcatggtggggctgcctgtggtttttttttttttttttctttctttctttctccccctgctgtttcctgatgggactgtttttttgtttttttttttgttttttttttttttttttgggaggggaaaagagaacagtcagggaagggcttatgtgatagtttttctcagttctgggaaaataaccttgtttcctgtgatgcactcttcaattcctcactttctctgaagcaacgatgtctctgggttttggatccatactggtttgagaggggaagactgaggggaggcttttaaagcagttcttgctgtttctttcttaaatataattagatgcgcctcattacctcacactgaaggacttttgtactttttcgagctgtgttttctgagatcttccgtgggcgacggcttgtcgtttccacttgcagttaattgcattagcaggtattttccccccgcccctcccgccccggcatatttgtcctctcttctcgctctccccaagatatctggagtcgattttgcgagtccgaaggccacacccagggagtctgcttgtgcctgaacgtgatgaaggatctggattcctttggcccttcccagtttccctttcctccacctcattcttttttcttaaagtcttccccggacagtttactaacaatgctctgctctcttgcactccaaggtcaggacccctgttccctataaaacccagatgaagaactgtatccatgcaactcagaggcggtccctggagagcatcccatgtggctactgttctgaaacgaccacaaccgcccaggaaactcaccaggctccgacacccaggtttggccaaagtcacaagatagccacggatataccctgccattcccatgaagggaacgctatagaagtgggggcgcagggcagttgcaagcctgtatggcagaaaggggaaggaataaaatgctctcccataaaccccttcggaccttcattcctttaagatttagggaatggtgttggggtggaaccatgtaaaataattaaaacattcggtccctgtttatcttttgcttccttctctgtgccttgttctgaaaataaactttgcagttagtttccgggctcccaaaattcccaagtgtgtgagcgtcctcaaggctttgggcagagttaatgaccggcttgaggttcactggacgtgtttcccccaggcgagccacctttttttccttaacttcagtttctgggtagcagatctctcttctctgcatggagaccttcctggtcacaggaggaaacctcacttgctgatgccttctaaggcctcagtggatcaggaatgggtggtgtgtgtgttcacacaaaacaacaacaacaacaacaacaacaacaacaacaacaacaacaaaaggaggaataagggctgccaaaccgcaacatgcaggcaacgggcatttaagttttatattgacagcgaggcaggatcctggtcagatacctgaaactcttccaatttcaaggaatctattccgcgactctctctcttccctgtctttagtggtagaagggggctggtattaggtttgagttcacgtgttttctttttgcatcctcactgcttgggctgcctctcaaatctccacacagccaaaacctgcctccaacccaccatttcctgtcatctcctccactgtaaccctcctggcccagtcacatctcctcttgctggaaacctgtaatgccttctaaatggtccccacactcttctcctgccccattgcagtccgctcatcaatgagcgacccagagggatcctttaaaaacccaaatcagggccgagcacagtggcttatgcctataatcctagcattctgggaggccgaggtgggtggatcacttgaggtcaggagttcaagaccagcctgggcaacatggcaaaaccccgtctctactaaaaatacaaaaaaaaaaaaaaaaaaaaattagccaggcatggcggcacatgcttgcaatcccagctactcgggaggcaggagaaacgcttgaacctgggaggtggaggctgcagtgaaccgagatagcgccactgcactccagcctgggtgacagagcaagaccccctctcaaaaccaaccaaccaaccaaccaaatacccaaatcagattaagcccatttccctgctgaaaaccccacttggcctggtgtggtggcttacacctctaattccagcactttggaaggctgaggcgggcggattacttgaggtcaggagttcgagaccagcctggccaacatggtgaaaccctgtctctactaaaactaaaaaaattagctgggcatagtggctcatgcctgtaatcccagctacttgagatgctgaggcaggagaatcacttgaacccaggaggtggaggctgcagtgagctgagattgcaccactgcactctagcctaggcaacagagagagactatgtctccaaaacaaacaaacaaacaaacaaaaaaaccactggtggcccctgcctgcttctccaacttggtcttgagccatctccccttcaccttttatgttccagccacactagcctcattttcatcaccagtagagtgaggatgtaacaacgcctgctcagagggctgggaggagtaagtgcattaacacacacaaaacatctagaccagggtctggccatgataggtgctcgataaagggaagtgccattaacagtttacttctttgaatttgccaaggacttttcccgcttcaagacctcacaaaagcctctgtcacttatcatttcccctttatatggctggctcttttttatcctttgggttcaagtttacatgttaactctttagagatcttctctaaccagtctattcaaatacattcccaacgcttgaacccccattcccattattttctcctacaacaccctgtctgtttccttcaaagcactttttccaacttgggatgacaaatgattttttacttggggggcagggctatgtctaataatcttatccagcacaaggaatatttgtggaatgaatgcataaatgaatgaatgtaactccttacctttcttctgctaataccagagccatccccaacccacctcgtcggctatgccaattctcctctccaaatcctgtatttacttattctctcatcctttggcattattgactctctggtctcttggcaatggaaaaacctctaaaccatctagcaccgtcccatcactctaggaggctcacactttcatttatatgtaaatgataaataatagaatatgtaacgcccagaataagttcaatgactaatgactcctcatctgccaagtcagaagggtttggggatgaattaactcatcaactaccattaagagatcaatgtcaatgcaattactccataaatatccaagatcaggtatcttacagtgctacctgaaagtctcaagtgatgataggaagtcaagtgcaggtgaaagcatagttcccatttttgttccttatcacctccctttatgtgagtacactgtattatattgaagctgagtaacatgagctaaggaggagtaacttgacctgtcctcatgcatctctctttcttgctctcttagccaagaataccaagatggaaaatgccctcggctgaattttttattatttattgattgatagccttcttcttcttctccttttttttttttttttccttaaacctccatgcactttgctaattacttctctggaaatcatttccctttaccattctccagaatgctgccacctttgggaaggaacgtggcagtgtgataaaatgtaggctagacaagagctaagagtggaaaaaagtcttcttcttgatgtgctggtccagccctatcctgccatctaatatgctgggaatgcaatgatgtaataatgagaacaagcacaaggcttgcatcagagcaatttttttcatccacagaataagcataaaggaaagtgccttcatcatttcatcttcggccccacctagatttgcagcatcagcatgactaagtcatggaagcaagctgatttcatcagcacattggaggcacttggtccaattaatgtgacttgaaggtgacatttgtatatccctcagaccaaaatactcaatgacgtgagttattagaaaaagcccaaataacgattaattcctaaaattaatatctgcactccagcctgggcaacagagcaagactccgtctcaaaaccaaccaaccaaccagccaaccaaccaaccaaccaaccaaatacccaagtcaaattcaaattgagtgagataatggttggagggaaaataaaaatatcttccattctatgcaaaagaggctccagtgctttgtagctgtttgaatgggtagcagataaatggggtttttggaaatgaactttctagaattttatagtgaaaacttgcggaacaaaagagaatactaatgttaaaggggaaggagaaaatgtttctttaatgtgacacatatcgtcataatggcaccttacatttagagattacttttctttggaagcgtatgaaacattatgtgcacagcattgtgagccgcaagaacataggtatccctactttaaagatgggaagaacagattcacagatgtgatctttcccaaaatacacagaacactggcatacagccaatatggttatattaccattcaggagtttctgtgtttccacagatctcagactagaccaaatacaattttttgggtagtggacttgaatagaagaggcagccaattcctatttaactgaacaaagaaagtaaatgttgattgtgtttctactacatataaagagtaggaaagggataggccttgttctcaaggaatttatagcttagtggaggagacagacatatgagctcactttaatgcaaagcactgttaaataaagcattgagcaagggacactgacaattagttgtggaggcgcggtagggaaagagctgctgcgaacaggggctgctatgacagtcagcctcacgtgaaaaacagaaagacccatcagtcggggcgggctacctctctgcaggcatcagggaatccttctagcttccttactctgagctgagatctacctaactgtagcttccaccaggtgcttctagctttgtcctctgaagcaatgtaaattagtttaatccctctcccacacaccatccttcaaaattctaaatgtggatgactttttcttttttttttgagacagggtctcactccggagtacagtggtgtgatcctggctcactgcaacctctgcctcctcagttccaacaattttcctgcctcagcctcctgagtagctaggattacaggcacccgccacaacacccagctatttttttgaatttttagtagagatggggtttgaccatgttgaccaggctagtctcaaacttctgacctcaagtgatccgcctgcctcgtactcccaaagtgctgggatcgcaggcgtgagccaccgcgcctgaccatagatgacatttctttccttctccccagtgcccctaccccaaagactccttcatcattttcctcttttggattaaatgtgccaatttcttcaactcatttgtctatggcatgattccccagtccttcactctctagcattcttctcttgataaattccactttattcatgttcatccttaaacatggcattgaaaattcaacacaatagtttattttatttttatttttgttgagaccaggtctcactatgttgcccaggctggtttcaaacttctgtcctgaagcgatcctctcaccttaaccttccaaatagctgggattacaggcacagaagcatggcagaagcaatataatattttagatatgtgttgactagtgagtcagttccatcccattatccgtccatccatcctcccatctatccattcatccatccatccatgcacctacccacccaacgatacgtaaataagcttttgttatatgaagcactgtttagtcactacaggggatacaatgatgaaaattgtaaatgaaagtcaaattgagtgagataatggttggagggaaccatgctcacaccaacataaccaaagattttattagtgtttttggcagccgtaactcatacagttagcatctactgaccttgtggatacctggacttctaatatattctcaccaaatttatgtttacacagattgcccttgtttggtggcttggcatttgatttctggaaccaaagttcagcactatacattgatttttaccattttaagtttcagtcaactgtttacttcattgagatcttttgggaatctagatcctgtcctctgacatcaaaccattccttttatttctgggccacctacaagtaacacaagtagcttagcccagaaccttgggcctttcaagacagctttgactccactcccctccatgactatcaagttttcatttctttgaccatcaaggagctcatgaacagttttggtcaaaggttatattgaaatcaagatgctgagtgcccaaagaatgttacaaatttactagcacaagtgccaaataaataagtgcattaataaaaaaaaataatagaactaagtaccaggccttatccaaccccatttttgtagagggctcaaactgctcacgtggaaattggcaactctagaaggttagggaaagagggtctccctgctcaactcagagacactaaatcaggagattaagtctccaagttgtctctggggctagagggaatgaataacagggtcctttatacgcatcttggatttctgctttttaaatgaaatccactgggccctatcagtctgtggtttgtctgctccgcttttagcaaactcgagatggggttgcgccgtgactggttagagcattttgcccttcagaagggggacccactgacccctgaccacagccttgtcatacagagagtgtcagaggcggtccaattacctaagaggactgagaaaaatcaaacagagctcgggcacaatgaggggaaaaaacacacagcaggcccagctttagctccactgcttgaattaccactatgtcaatagaaggtgataaatcaagggagatatttactgattaaaattacagactcctacgggaaactgtataaacagattgaagaacaaagcctgcagggactgagcccagccgaatccatccaggctttggccagtcgttcctgtttccagccaactcttggacccaggggtcactgagagagcaagttgctccacgaaacgcaggcttgctgtacacagatccaaatatttgtagggaaaatttaaaggcatgttgggaagagattcagggctcatacccattcacaaggaatcctcttatttcattcttctctttattttattattatttttttgcctttactctgaagtttggtctagactcactagaaagacccagaaagctgctctgtatactctacctgccagcagaggtgctgaggctacaaatacagaagggaggcggatataggagacgtgagtgggcacgaagccacgcccatcagaggttcaagaattgcatgtgtagccaatcaactttctatgccaatccactgtgtttaccctctctggggtgctcatgttggtgttcccaggggaaatgaatctctgctctgccaccctagtccctcagtgtgtatcacttgcttactgtcattctgctgctgttttttttttttgagacagaatctcactctatagcccaggctggagtgcagtggtgctatctcagctcactgcaacctccgcttcccgggttcaagcgattctcgtgcctcagcctcctgagtagctgggattacaggtgcgcaccaccacacccagctaatttttgcatttctagttgagacagggtttcaccattttggtcaggctggtctcaaacttatggcctcaaatgatccacccgccttggccgcccaaagtgctgggattacaggcgtgagccaccgcgcctggcccattgtgcttctttaaatggcattctccttgagtcagagaaataccttttgggaatgtcttggagtaatttgtgtaggcagggctttggaagcaaggctgcagctagtttttttgtttgtttgttttgttttgttttgttttgttttgttttgttttgagatggagtcttgctctgttgccaggctggagtgcagtggtataatctcggctcactgcaaccaccgactccctgcttcaagcgattctcctgcctcagcctcctgagtagctgggattacaggcacacgccagcatgcccagctaatttttgtatttttagtagagataaggtttctccatgttggtctccatctcctgacccactgatctgcctgcctcagcctccaaaagtactgggattacaggcatgagccaccatgcccagccagctgcagctagtttttagagccccatggatttcttcttgccagctctgtctgtgggattaggaccatcaccccaaaccactgtatcctgataaagggcagtataggtttatgtctcatgaatgggggaaactcacaaaaggctgtttaatgtcaccactggttccattattcatgagtagtctcggggttaaattttgcccttgtaacccaagttctatcccctcttcttgtgcccttgactgtgaatatacaatcatcacttaaagagaactgagcaaacgtgttctgggacaaatgagctttaatgattgggaggtgggagatgatcatctatgcaatgtcaagaaataacagaagtctgttggggatatagttcccgttagggctgctgtgtgtggttgggcgttctgtgaactatgtaaaggcaccagctgaaggcacaattgtgggctgaaagcagctgatgttctacctgccaatctgccatgcaagccctgactcagggtggcatccaccaagagggacaggtaactttttcttcacactgaggagaagttggttattcaagccagcagtccttcgggttttgtttactgagtgggagcactcttctctaattgttcctccagaggagggcagcttgtttcatatgatacaagggtacagaataggctagacaaggctcagaatcttctgaccttttcctcagagctgggaggaagttcaggtgaagaaaatcccaactagagcattcagaagctcatcctctaaaacagtagggagggccgggtgaggtggctcacgcctgtaatccaagcactttgggaggccaaggcgggcagatcacctgaggttgggagttcgagaccaccctggccgacacagtgaaaccccatctctactaaaaatacaaaacttagctgagtgtggtggcgcatgcctgtaatcccagctactcgggaggctgaggcatgagaatcgcttgaacctgggaggcagaggttgcagtgagccaagatcgtgccactgcattccagcccaggtggcagagagagactctgtcgcaaaacaaaacaaaaaaaacagtatggagatctcaaataactaaaaatagaactaccatccgatctagcaatcccactactgggtatctacccaaagggaaagaaatcgttacatcagaaaggcatgtgcattcatgtattaatcacagcactatccacaatagcaaagacatggaatcaacttaagtgttatccaatgaagaactggataaagaaaatgtgtgtatataccatggaataatattcagccatcagaagaatgaaatcatgtcttttgcagcaacatgaatagaactagaggccattatcctaactgaaatagctgaaaaacagaaagtccaatactgcatgctctcacttctaagtgagaactaaacaatgggtacccatggacatacagattacaatcacagacactggagactgcaaaaggcgggaggggggaggggtgaaaaattacctcttggggccgggcgtggtggctcacgcctgtaatcccagcactttggaaggccgaggtgggtggatcacctcaggtcaggagttcaagaccagcctgaccaatatggtgaaaccccatctctactaaaaatacaaaatttagcggggtgtggtggtgggcgcctgtagtcccagctactcgggaggctgagacaggagaattgcttgaacccaggaagcagaggttgcagtgagccaagatcgtgccactgcactccagcctgggcaacagagtaagactccgtctaaaacaaaacaaaaaaaattacctcttaggtacaatgttcactatttgggtgatgcggacactaaaagccagacttcatcactgtgtgatatatgcatgtaggaagcctgcatgtgtaccctctaaatatataaaaatgcaaaaaataaaaataaaaaaagatagacgttcaccctttgccttttaaaaggcagcagtggataataaaatgtctggagaatgatcctggcttgctctctggtccttttgcaactggattactgtaaagtgaggtgggtgtttctttgtgttttccccctgaaggggtccatccaatgttccctgtctgagtgactgaactccttgttcacggctgtcactgaacccatctctctccatcagcctctggagatggttggggctacagcccagacttcacacgctgtcttacgtttgggaaaactctgcgctatcctttattactttttttcctaaaggaagttatgtttatagctgctgcgcctgactgctctgccctctgtgagcctcctctgaatggtttccagggtgcgtccttatctgtgagcggaagtgcgttttggagatggggagaaattaatgacgatttcgggagctgggaaggtgaggtcggctcctgcgaaccgtgggggcgctctgatctcgttcttatgctctgcttgctgaaaaaatctctctttgccctggaatatcatggcctggagccctttaaattaaaaacagttgtgaaactggcagcaatttagaacttttgccagcgcatgaatctgtaaagagcagggcctcagggatgcggaccatgtgtctctaaagaagaggcctggtctgtgtccttggctttgagcaccccaggcttttggtctactgcgtcttttctctcctagaggtatatgggctctttcgggttgtgaccagaccctcccttctgacctcaccatctaccctgtcccacctccaggggtgctagggcttgccacgtggctcagtggtgtcaccagtgtttcctccagtcagtgatggatgcgtccaggcaggggcccacacctctactttcagagtgatcaagagacagcaatgcagccacctgcagacctttgcagccaatgtgaatccaagcgagggtttcatggaagacatttttgtcagttttcaggagaaggcagtggaagtggaaatgccagacagacaataaaatagtgaggtgaggatgagccagtaaaattccttctttgtgtttatggcttggctgcttctaagccaggaggtgctctgccactgcccaagtggggatttatttcaaatgggctcagccagagggaaaggcaggtcgtgagcctgtggggcaggtggagagtcaaaatctcgactcttcctgggaaaaaccttcctagggacactctccctagcattccggccaccccagtgtggggttcttgcttgcagggtcctagaacatccttgattgcctggcatctttaattaaaagtgaaatccatttgcaaggatgaggaggcccaaggattcaatgtcagtgaaaccctatttgggagaaaaaaaatgtcaaacgtaaacctgaaaacataattgttcccttaatgaaattcagagtgaatttcaattttgacctgaaattcaacaggttatcctgagaaacattcattgattatctcccgtgtgtgaaagtaggaaccaggctggtgagatcggcagggccggtgcacagcagatattgtgtgcaaagttaaggaacatgcaccatctcttttttttttttttctgagacagcgtctcagtcacccaggctggagtgtagtgctatcatcatagctcactgcagccttgacttcctatgctcaagtgatcctcctgcctcagcctccctggtagctgggactacatgtaccatctcttataggcagtcaatattttaaagaagggacgacctgagcagagctgtgctttataagagccatattagaatgatgttgagggcataggtgatggctaatatttcttgaacacctactatgtgccgggaagtgggttgtcttattatatgcagtctcttttaaaatccccatgtaaccgtatgaggtaagcattattcctgtcctcattttaccaaatggcaacctgaggttcagggaggttgagacatttgtccaacgttgcacagcttgcaagtggcagagcaaagggcggaacccaagtctaactgagtcaagagcccacactcttaactactatagatcaagcttaatatatacagtgtttgctttatcaaggagtaagcaagtatcccccaaaagctattccttttgtgtggaatgggcaaacctctggatttgagagcgtgagactcagaggttggggctgtcagttttagcacataaaaatgcaaaactgactcccagttaaatttgaagaattgctctaatgaatttttgtaatgtattaaaaatagctgaatgcaggacaatttgggcattttgacaaagtgaataatgacacgagatgaaattattaaggacaggacacgacttgtacacatgggccccctagatccccagccacaggggtccccaatccccgggccacggaccagtactggtccatggcctgtcaggagccggatcacacagcaggaggtaagtggtgcgcacgcaagtgaagcttcatctgtgtttacagctgctccctatccctctcattaccaccttagctctgcctcccgtcagatcagcagcggcatgagattctcataggagcgcaaacccttttgggaactgcatatgcgagggatctaggttgcgcactccctgtgagaatctaatgcctgatgatctgtcactgtctcccatcacccccacatgggaccatctagttgcaagaaaacaagctcagggctcccactgattctacatgatagtaagttgtataattcattatatgttacaatgtaattataatagaaataaagtgcacaataaatggaacatgcttgaatcaccccgaagccatgccccctcaccatctgtggaaaaactgccttccatgaaactggtccctggtgccaaaaagatttgggactgctgccctaccaggtgtgtaccttgggtctgtcacaccttaggctgtgtgatcgtgaatagaacccccctcacctagctcactctctgtaactgcaaaatatggacaatagcatttgcctcgtagagttattagagggtgaactgagacgacataaaatacccagtagtgtgcaaggtatatagtaggtactcaagaaacactttgtggatataccagccaattccctagtttccaggaaaagttttttttttttttttcactcaaaacacttaactcctattgagtgttttatgcatcaaagaacttggccttttcttcatgaaaaacatatcttttaatgggggtcgcatttcgatgtttcatccatcctatatttaaaaacaccagccatttctcctaacgataaagttgttacacaagttaaaaaaaatagggcaacagaaacaatgcccattatattattgtcaagcctttattatgtaggtattaaatttgacctcagaggtcatcactcttggaaaatgtttccatctgtagcactccattctccattctgttggttcaattaagcctaagaatttaaattatctctctaactctaaaaatatgtacagatactactgaaacgggaaactatttcagggcttagaagaaattctgtaggagtgaatgtgctcacagctttcaggccagaaaggttgacccttccagatctttcaaaggttgtggaaagactgtggaaatcaaatcaaatcaagtcaaaatagacaggctttctctcaagaagagggtttggaagagaggcggggggatggacaagttgtatgtctcacacacacacacacacacacacacacactcactcagtgggaaatgtgtttgtctaaaaacattaaattaacaacttctttgagtgacagcatttcttcctttctttctcttatttccagttcattcttatcagaattctgtcagctctcaagctgacattttcctgttctgatcttttctcagatagtaaagagggatttttttttttttaaattgggctgatgcaaacagcagatcagcctacagagaaacgtcaaggacagtttgtagtcctaatccctgacccccctgccctctcctaactagctattgacattgaacttaaaaaaactgcaatgccgagatgagataatgttttagaggaaagagaaaaggagtgtggtgagactcctgtggcagatgggggcatttcagaagtgaatgtgctgctggcctgtgagttaaacttcaggcttttcaaagttcagttttgcttaaagtatctggtaaagaaaacgggtctcatcctctagaccagaaatggagcaggcgagtctctttggatgacagcgatttgccctctttgggtgatcctggctttgttcacgtgaagtggtgacactttcatgatgcttggtgtagagaaactgttggcgtggtttctacattggacaaagcactccttttcacgtcacccacgttgcataacagagctgggctttataatgcaaaagtttggaacttttttttttgagacggagtctcgctctgtcgcccaggctggagtgcaatggcgtgatctcggctcactgcaagctccgcctcccaggttcatgccattctcctgccttagtttcccaagtagtagctgggactacaggcgcctgccaccacgcctggctaattttttgtatttttagtggagacggggtttcactctgttagccaggatggtcttgatctcctgaccttgtgatccgcctgcctcggcctcccaaagtgcagggattacaggcatgagccactgtgcccggccaggtttggaatttttaacagggatatctttattattattattttccttttaagagacagggtctggctctgtcacccaggctggagtgcagtgacacaatcttaccttactgcagcctctaactcctgggctgcagcgatcctccggcctcggcctcccaaagcactgcgattacaggcatgagtcaccaggcctagcccttaaaaggggtccctaaagggacttttgcagccatttcaaaatagagaaggagaaagaaccttgccaatactctgtttggacccctttgtcctctcgagctgatgagcttcggtccaccttcctgtgaagacactctcacctgagatggtgaatttgacttgcttcctctctagtggggaaacagggacaaagagagaaatagttttttcagaaaaccctgactaaactattgtgaagtcacctgcccttattttcctatcacttggtcctgcatgttgtagaataaagccctggcatctctgaaaatatttccgctattttgctactgttggaaaggtggctttgttgactggtgaccaaaccagaagaaaacctgagagagaaaatgttagattcccaggggtaggatttgtttagtttcagaacaaatcctgaaacacttaggttctcactttttcccctatggctatttacagggaggctagcgtctggatatttctttttctttttttttttttttgagatggagtcttgctcttttgcccaggctggagtgcagtggcgtggtcttggctcactacaacctccgcctcctgggttcaagcgattctcctgcctcagcctcccaagtagctgggattacaggcgcaagctaccacgcctggctactttttgtatttttagtaaagacaggatttcaccatattggccaggctggtctcgatctcttgaccttgtgatccacccagttcagcctcccaaagtgctgggattacaggcatgagccaccgcgcccgcccacatctgggtatttctaagaggcagtatgttatcctgcttaacataaaagggtgaagacattctccaacgtctctaccttctagaagctgctgggccacaccccggggattccaaaccctttccgggcatgccaaaggccagtgagcagctagcagaattctaatcacgtgatcattgttcactggggtcggcagatgccactgtcattgcttcctttacgtttattgcttgagacacttgaaattaggcctgacatagcaataacaaatgtactacagggaacgagccggcactggaccctagggaatgatctagaagacttaataggtcttttccgtctttaatttccatggttctaaatatgccggctgcttataaagcagaagattgattctgaggcagactggttagttttggaagcagtgagtggagaggattttgctttttgcagccatgttccttgatgcccactttaggctggatgtggtttctgagggcagccctggcatctctcctttcacctctctttggtagggagcaaatggggaaggagttgtcttgggcattccccctgagctcaccaacaaggtatgagcatctccgtgtaccgggaactcctccttgtctgtatggtgaaagtgtaaggactgggcaggcatggtggctcatgcctgtaatcctagtgctttaggaggctgaggcaggagggtcacctgagcccaggagttcaagaccagcctgggcaacatagggagaccctcatctctaaaaaaattaaaaaaaaaattaaaaactaaaagtctaaagacacacaattgagaaatggaggtgatgttatgggctcaccaacatctcacatccactcttgaaagaagccaagtgctcagcgtcagtggtgagcctccctaggaagaagtctttttgtttcttcataagatagagtgagcatcttgaccactccttatctgaggccaagggactaagactcaccttaaggaacgcacctttggaagcaggaagctgctgacatgtgtaatggtgtgacttcgtattacacagctggtgaattcattttggaagtggctgtgtgggggaagaagttgctgtttttcctttggtaattgttcccattggcttcgcccacccccatccccactatgatgcaaggaaacaattataggaataaaaaagacacagctaagtttagagagaatggggacaggcactaggagtttccaagttttctttgagctcacacatagattgcctttttctggacatgggaaagaagaacaatttcagtttttccagccataaaacagggaacttaatgattgcttgcatcatagaaaatgttataaggacaaactagcttacatttttacactggcctgcagacacactctattacataagtgaagaggatctttcatgacagtgaaggtgtgcgtaagaaggggacccaggcatctgttcacttttctgtctccatttccagggtgagatacacagctggaaaagctacttgttgtggctgatgaaatgccagcactgatatcatgctttgaaccgttttatccggatttaaggagccagtttccaattaatcagactccaaggtcactcaccgaaccagtgtctcaggtagaggaggattatgtgtgggggagagcagagtggggacatgagggactacagggcgaaggaagaaaagggagaaggatagagaccagggtgaagagggactggatttttttttttttgtaaattgccggaatttgaaataatcattggttaggggaaacgtgttggcttactaaaaaccctttttagtttgctaccccctaaaaatgggaccaaatccatggctgaaaaggatcctgctttcctggtggctgtgtggtggctctgcccagcctgatgtcatattcagaggcgtgggagaggcagagcccctcctgcaggagctgtttcatcaggattctgtgggctttctatgcaacccctcttaaaaatctgaaaatgaaacaagacatatttctgaggttgtcagcaggtagatccactggtttgtggtaagtaatctctctgggaggaagtcttggctctgatgtctgtgttgaacgttccgtggctccccccggccgccccagcacaggtctgttcgctgggcaaggaggcggtgatgatattgcttctaacaaccagactgaagcgtagcctcaggctgtcttgcaaagccccttccaaactgcctctaattaatttttatcctgccatcccaatgagtcccgggggtacaacaacccaacaacagaaaaaccctcatcaagtcatttggagaaagctttgacgtaacgcttgcagattttagatctccaaaagaggaaatgctgcagaaaaacaaaaaaccaaaccaaacccctcccgtttggtcacctccatcctactcgatttttccccccagattctcaccttttctttacagtggcagtaagtctgatctctctctggtcccctctcacccacggctctttcagagacaatacagagctgtatttcttttttttttctgcgggaagacaaccctgaattccctgtggtctggggtcaggtacctgcactgggctgccctgggaatctcttaaaagaggggaaggagaaaagctggcctctctggcttgtagccgcggtggggccaggcctcctcatgctgtgcaaacacgctttagtggacatatgttgggagcagagggaaggttccacaaagaggaatctgacccaccaaacacatcaaacatgcagcaccctgggcctcccccgttagaagtgctgctggcagcagctcagtcgccctacttggctgtgtggtggggggttcacgcaaaactattcaggttgcttttcttcttattccgaggggatctggggacagaggggtgccttcctccctggcactagcacatgagcctcacttgctaccttccctccagctctggaagtctcagcccctgggatcagatgtccactgatctcctccccaaacaccctatcccaccgccgttgcaaagccctccctgcccctctgcgtctgttcaggatgcttctcttaggaccttggaatgaatgaaaatttaggaagagtgactgtttgaaatgaggcattgagaggtgctgaaacccaaaccacccgccgccctggcttcctgggatttctggacaaaaaaggttgagtgacttctcccctccccgggacacaacagaggagagtgatccggtgccagcggccctggtgttaatttcatgatcaccgggtgccaaagaaagttactcaggatccgctggactcgacagctcctgagaaatggagtctttgtttctaatgcgtctgagctgtctggctcctttaaaagagttaatcacagaatcacaggcctagaaaaagacttcttggatggctcctctgtgctaggtccaagtgagtgagggctgatcctgtttttgaagaagcccgtggagcaccactccagtgactaatcgctcgtaattgtcctcgttaattttaacctcatgcgctggtgctttaagcagatttccatttgtccgtcctcagagaaggtggaaggcattgctcatcgcacaaatggggtcattcatttccttccctctcctttttcttgtctccttgggcgatcgactggcccaacagggaagagcaaatggtggggagctggacacaagtgggtctaaagtctgcaacttcctaactatgctgctaagcctcagtttccctgtctgtgaaactggaggaataatagccacctcattgggttgttttgaggattaaatgaaataatggaaggaaagtgctttgcgtgggttcagggtgatgcctcctacaggctcacaaacaaaaatgtgccctctgcaggaaaggtggatgcacgtggaattcctgcttttcggggtaccctgttcttcagtgccaagtgatattggtggatgagacagcaaagagcagtggaaagagaattgttactgggggcctgaagatgtgggtcctattcacagctctgctataacctagtcttgtgaccctcactcaggaaggcaccacctctctgggcctcagttttctagcctgtaacataatctccaccctgtctgctttgcaggggagttggggagcaactgaggaaaggagagatgggggcggtgaactgccaacagaaagtgctagtcaaatgtcaggtgtgaagagtcctgaaggtcgatgctcaaccagctctgctgctgcccctggcattttccctggcaccaaggaacatgttgacagtttgctgggatccccctgaatttccagtatcctgggggtaaggactggagtgaagcaagttaaggtatatattatctgactcactttgtagggttcacagttccttagaccctcagttctggtttgttttgaaaggggacaacccctgtctgggaggagcctttagtcaagaggcagtactgcatagtggtgaagcagtttgttaaaccccacagactatggggccagaccctggtcatattctaactctgccactttccctcctatgtccttgggaagccgcctgcctctctgtgtttcagcatcctcagctgtacagtggggataataggaattcccatctgataaggattgtgtaagtatgcaccacatgcttaaaccatgccctggcacatggtatacactcaagatgtagtgacagtataatcgtcatgagtcaaatgtttgtggtccatgcagtgatgaagcctgattcgtttctgaaagacctcgctaggaccctctagtccagtgggttcttaagcttctgagggccacggcttgtatgacaaatgttatgaactttctctgctgaagagttaacatatgcccctaaacttcacatatatcttcagggtgttccaacccatccatggaattgctggggttcatagaccccggtttaggaacttcttttttattttattttattgccttcctttattttgtttatttattttgagacagggtctcattttgtcacccaggctggagtgcagtggtgcgatcatggctcactgcagcctcgacctcccaggctcaagcaatcctcccaccacagcctccagagtagctggcactataggcgtgcaccaccacccccagctaatttttgtattttcagtacagatggggtttcaccatgttatccaggctggtctcaaactcctgggctcaagtgatcctcccaccttggcctcccaaagtgctgggattacaggcatgagccactgcatccaaccttattgccttcttacttgctaggtcaccaggatcatccaagtacagttttggatatagtaaggaaaagtatctggtataataaaattatattatggttacgtcaactagaggtccaaaaaagaaagaaaatgtatgatataattgaacccaagctaggcttcataaatctttttcttgagtggtatgcctttgatgcatgtcattgcaatttttgtccacacccaattcacactgctctgagagaatcctggagaaactttctctttgcctctatttccatggcaattgtgaatagccaagagtcactttgttaagaattcctaattctggagaaatggaaggtcaaagtcatgaacctctcagttaatagtggaagtttccttattttaagttttatgaagaactctcttaagtatggtgtttataggctagggtttgcaagaacctgaatcaaaaaacaaataatagcaaacatacccttcgctaggattctacctggatgacctcattataatttggtaggaattaagggttagacccacaagagtttcattttcaggttagacagaagcatatttcaagtctctccaaatacctacttaacaaataccaccttttgcatgttcttgatttatttctctacttctataccattggctttgcaaaattaatttgccacatggaaatttcttaaatcactttctcaccaaaccatgaatatggtttggaaaagggagaaggggaggaccctttgttttttctattaagggctgataacccacaggaaaaactgattttttccgaaaaaatcaaatatctgcattttcttttcttagggaaacaaatacctgtttggaaaattaagtacagagaagatacagaaatactacaaaatatggttgtgtctttactatttttttttttttttttttttttgagatggagtcttgctctgtcacccaggctggactgcagtggtgtgatctgggctcactacaacctccgccacctgggttcaagtgattcttctgcctcagcctcccgagcagctgggactacaggcatgcaccaccacacccagctagtttttgtatttttagtagagacggggtttcaccatattggccaggctggtcctgaattcctgaccttgtgatccatctgccttggcctttcaaagtgctgggattacaggcgtgagccaccacgcctggcctgtgtctttactattatatccaatttaagtggctagaaagcaaaaaaaataggacaggtaaaggttggtgaaggggaatcaggaacggcaggaagtgctagagagagtgaggggcctgactgaacaggtgggagagaagcggtggttgcagaagagatggatttgggtcaggcagttacaccaatggtgcagagaggaaagataatgtagcaaccactagttaccatctttatacgtgtatatctttgtatctccctcattgcctaacacacatgccgtgtacatattaggtactcagtaagttaatgaaacagaaacaaagagaatgtgtaaaacaccagaagctgtaaaattaattttgacttagaagtgtactttatctaggctgtgatcttaccattattatcaagtgccatctgtttctcttgaaatagtttttttttttttttggaggggggatgggtgggggttggtgcagtttaattgctcttcacaggtcttcaactgctttaattaatcccaagcttcagaagctctaccccgaatgggatatctagagcttcctccttggggtggtggggagggccagattttcctcaagactgcaataggagtgcgcagaaatcatatcacagtgagcttgggagctccctgtggacttgggttagcaatttcccatcctgatggctacggacttcgatacagcctagtgacgccatatttgtagatcatagacaactgcttacatttcttctctgaaaaataattctgaactggggcttgaaaacatagagttgagaaacaaaggacaagggaaacattaattttgtgcttaacactcaacagtagtgtccatcctggccagaaaaaaaaaaaaagtgttctcctggtttgagagaatctggctttagcagaacatctgagttggaatcccatgtagctatggaatgaaaatgtgccatatttgaatgactggtctgtccactccttataatgacatctagcccaaataatagacccatacgtgtaggtggcacttaaaaaataccattcaccagaaggaggttttgagaggactctacctcactatttcagccatgcttgaaataactgcaaatggtcccatgccacatgaaaggcactaagtggcattccttggatgagcagggagcccaggactcttgatggtaggcgttctggagggccatggagctgggacactggtattgacatggtgacccctagtgtttcctgttggtagcacgacttggaacaccaccagcaaccctggcctaagtagggcgtctttaccatcttctgatggaaggagttattgcccaccataattgtttatgtctttaaaaccatcatgttaaacaatcccccccttcaactttaatgcatttttctgcacaatatccacttctaacccctgctgaatagaactgagtcttgacactgttgttttcttataatgtgtggcctcctgtctaagcatttcaaagatcaagatatatcaattcattactgtggttacaatgtcataaacaatggataatggcatcaatggatgaattgttggaggaggtgggtattgctatatccacggcatgagagcgtgactaggaaggatttactatgagcacatgaagtagaggacaagctagcaaggtggatatggtgattggtccaagtaccatgtctgttgtctgttgtatttttcatctcagtaccctgctccagacattgtagcaaatgatgagtaaacataaagcaattggattgtatatgctcatgcaaggaggtgaggaaagtcaactaagcggataattcaaaccacctaaaccacttccccatgacttatctggatatttcagagaaaagtattttctttttgggatttgatcatgtgtatttctactaaacatgatagatgtcttcatttctaatgttacatactataggcagacacagcctgagggtaaaaaacaatgattacaactcattcattcattatcacaaaccttacttgacatagactaagtgggctgggaatgggctggccgttggttcaaatcccagtgcttttcagtttatggttattaccctgttttatttcaggtataaaagatgcttcttgtcagtgttccaaatgtacttgggtgtcggtaaagaaaaagaagataagtagagtatctgatttggtggtttttttttttttttttttttttttttttttgagatggagtattgctctgtcgccaaggctggagtgcagtggcacgatctcggctcactgcaacctctgcctcccaggttcaagtgattctcctgcctcagcctcctgagtagctgggactacaggcgcgtgctgccatgaccggctaattttttgtatttttagtagaggtggggtttcactgtgttagccaggatggtctccatcttctgacctagtgatccgcccgcctcaggctcccaaagtgttaagattacaggtgtgagccaccatgcccagccccttatttggtgtttgaagaatcatgtcaccgttatcacaaagactgtaagtcttttaactgcatgaataccattggttactttattctcttccatgctggtatctttttttttttttttttgaagtttaaccccattgctggacataccagtgttatgaagaagaaaataaactaaaaaatgcttattttatgcagaaaggtataattctgattaatagtaataaatcaaaataaatcggtagaatttctaagactcaagtgagagcttggggttcttctctagctttcgttgattatcgagaaacaaaggccagaaactgcatgtaaaacaaagaggcacaaaaggcaaatgtaatcccatcatttagatgagttcttgggtgacatctttgtggtttccttttcctatatctagacctccagattcagttggtggctcatcctcgctacagaaacttccttaatatgccagagggacatgttggaagcgaagggcttctgtcatcattgggaagggcagaaacaaaaggggactttcactcagatgcaggagggaagcaagttctcccaggcaaagccaacggcactggattctttcccccaacctacttgttatattcaaatacttcagactctcctttttataaaaaatcagttctgccttctcaaagcaaaccatcaacatcaaaaacaatgacattggatgtcattttaaatgaaaaagaaaaagaaataaacagattcaaatgtgagctcggggactctcgactttgtgaacgtcccgttcaaaacaaagctctttgactattaggctgagaccagagagttttaccttccaggtgtatatttctagagtcatctgtgaattggggggaaactttggaaactgatgtccaggttcaactataccatcaaattctggagaagattgctaacgtatgatcagaaaggaagaagacggtttgtgtagacaacgtggctggtccctcgtagaatggggcgtaacggggtacacttaggtatccagagtacagaaaacctgctgacaggtagacacctaaggtgacaaagaaattgccatatttattgctttagtgggataaaatgcatggttgtctaaaatgaaacggtagcaccaagtccatggcccatgaaagtgactctgctgccatctatgcccaaagcctcttgtttccaaggaagccggttttataggaatgcatcagaacatcttcttttaccttttgacaaaatgaaactgcgtccttgggagtttcccacccattgctctcttggctacttcactccagtactatttcattacttattgatttttcaacgcctctctgcatggctgtaatttacacaagtccttacagcccttagcgattcttaacacctcaaggtaagatcactgagtccactagagagagacattcttttctggaatgatgaaaaattggtgagtctccttgctaacacaggctcctttgggaggccatggtggatggaaagtaacatcacagtcctccaggtgctacagtgagagggtgaacgaggccaactccaaaatggatgttgtcacattcttgttatgctactgaagtctatgcaacttttatttccagaatgaaatacagagttttatagattggcagttcttagtgaaaaaaaagaaagcctatgaagtaacctgaaagctggtaacattggatttattatgatcttttaaaaaattaatcaccacactagtcaatttgtaaaatatgtgtttgcctttgttgtaatcaaggttccacatggaaaaaagaaatggaagtaaaggaaaatgtcagcatgatgaaaaaacatagaagaaaataagtgtcttctggagagtttttgagtaaaacataccagtgttatgaagaagaataaaaactaaaaaatgaatatcttatgcagaaaggtataattctgattaatagtagtaaatcgtattaaattggtggaatttctaaagtctcctatccagacttcattatttggccttcaaaagtttataattaaaaaaattactcagctattttgctatatattactaggaaatattttttgtttcagccataaaaccccttcatgaatttttattttatatatttagaattatggtgagaatgtgatttatacatttgaaggaaaatttaatattatcgaataatcatatgaaaaatgatatcttttcaaccaaagataggattgaattctcttgatgcttccactacaaaatgatattaaataaaagatcccttgaagaagtgtattttagattggccctgtgaggaagccatagtctgaaaaaaccgataaatgtcagactgtttacacagtatcatgtagcttacctaactctatgacctgaaaaccatttctggatgcttccaaaacaatgaacctaaccaattcacaaatcacagactttttttttaagcttaaagtgaatttagaaagcatctggaccaattatagttaatttgttgaaatcagggaaaataatcctatcaaaggagctatttagcatttgaatattttttaaaagccaattttttgatgacatactttactttttaattatgtattacctgttacgctcatgattattcatccttcacctgatgtaaaccacccaattttccaatgccttgggacgtactgagataattgtaatgaacatggtgcttgcttgctctgtattgcttccctttcttttgaaatgtgcactctaaatttcttttatggggaagcacctttccctgctctcagttcatttggtttgggcagggcagaccctactccctggctctaggttgatccaagccaggccagctggacactacaccaccttgtctacagtgatggacatgagctgagacagtgagagccaaagcaagatcttttgctgaaaccattggcaatgggggggctctgtccccttggggtatttatgctggtggatgtgagtttgggctgccaggggctaccacatgccaatagcccacctggaaatgaggcaaacacagaggaaaacagaaccaaagtaggtgtggggagagtaggggagtcagatattactgtttgagctgttgaatccagctaagcctaaagcagccaaccccatgcattttagtctatgaattaaaacactgccatttttacttaagctaatgtgaatctggttacagttagtttcaacccaaagaggcttgattaattaggacaattttatctgtgaacaatctgcatgtttcaaacttattctgaaataaatttggaatgcttaggcaggttcactaaattaaaagggcttcaacaattttgttgtccatgtgagaggaaaatgctgcaaaagcatcttagacttggctgtgcaactgctttggtatgagaaacgctctactagagcaagaagagagaagctgaaaaatccttaaaaataataatgaagatgaagattcactatttttgtttcgttttggttcaggtaatgctgaattacatgaaatctccttaagaatagtcactgtattttcttagcatctgcaataccaaacaaagagctagaagcacagtaggcatttactggactaaacttattagaaagaattgctgcctgtccttcatgcttcctacatattgatgaatgaaagccacttacggcgtggtagtgtttctcaggaatttaacacaatccacaaatgatcagacttctctgaagattgacaaaattcccagaaaacaccaagaacataaatcagtgggaagaacatttttttttaactgtgactcacaatcattttcttaaaaaaggcatttaaatgtaaagatctcagctcaatattattcactataagtctgtgtagccaaccacccattctttgtccctgggtgatgtgtaagagtactgcccttgttagaattcataaatgtggccaaaacctgggctagactcaatatttctgagcccttgaaactctctagaatgaacaccattaaaagaatgtgttcattttgaatcacccatctcttagttatttcctaaccatctctttctgaaattaactgttggccaaaatagaataccaatcaaaagccacatggaagagaaatatgaagcctgagaagaaaatatgaacctcacccagggtgaatagctcaaagagtttctgtactaaggcagcccagccatatggccagtttggcccagaatcaaaatcaaagttgtaaaaccatcgctatggcaggggaagatgttcgggctgctggagtcgaaatgactacactgtaatgctgagactgggccaaccagatggtgctgagggaaccagacaggaattccacagcaggaagatggacttcggccccagtctagctttccaggctcacctctctgctaccctctgctccagccacactccactgctcgttggccttctttcatgtgatgcacttttcacatctctttgcctttgattttgcaggtccttctctctggaacgaccacctcctttgctctcctccacccccatcaaagtcatgaccatcccacccaccttactgtgcttttatccccagccctcctgcacactctgaactacctggggtgccacaaggcttcatctttctttctttcttttttttttttttttttttgcctccacgccttgacataacttttttttttctttttcgttcctatcttctaccctcttcttgatcttcccagcctagtcttctaaatttagctgaagcatcacctcctcctggaagccttccctgatctctccttttaatttaggagaccctcccccatgctcacacagcctcttggtgcctattttatcagcatctactccgtcgtccaggagtcactgacccacacgtgtatctcttccatatgcctggaatggccttgagggtcgagactatgcatcaactgactttgcattccttttgcttactgccaggcactcagtaggaagggtgggtggagagataaatggctggaaggaaggaaggatgacttaatccttcaaggccctgctttcatgtcacttcctctagaaagttccatggcccatccagtcctcttgtactttacatacagacattattttttaaaattcccacaatttgacttgcattatggataggccctgcttctctctttcaatagagcgtaagctctctgaggtcagaattcaatctccatctttatatccctaatgatgccttgttcctagtgggtgcatatttgtttctgttccataaacatttatggaaaattatttggtaccattaggccagaaaacatgtgaaaaccattcaaacaaattctgagctggacaggagactcttcctagctttggatatttaaaaagctggtccatctaacctgagctgggtgggctggggataggtgaatgctcatagtaataatactagctaacacttactgagcacttactgcagtatataggctgtactaagagacttatgtgtatcaaatcactaatttacaaatgctcagtggtacctgggcatgactcccatttgagccagtgacaattgtccatctatacctcaggggagagagttgggtctggtgagtttcagactggtatatgaaagctggaattgttctaagaattagcagagagcttcatcaattgctgtctgcctgcacttgagtatgttaagccaaaattactttgaactctgttaacctatgattttacaacttgaatggaaaagattcctctccgaatttcaagattttttttttagtaaataaacagttggtttttagacaggaaagaaagacaattgaggtggttttctccactgcagtggtccccaacttttttggcatcagggactggtttcatgaaagacagtttttccacggactatgggtcgggggtagggggaatggtttggggatgaatcaagcgcattacatttactgtgcactttatttctattattattatagaaattattatttctattattattatattcattataatatataatgaaataattatacaactcaccaaaatgtaggttcaatgggagctctgagcttgttttcctgcaactagcgggtaatgggagacagtgacagatcatcaggcattagattctcacaagaagtgcccaacctagatccctcgcaagtgcagttcacaatagggtttgtgctcctgtgagaatctaatgtcactgctcttgtgacaggaggcggagcccagtggtaatgcgagtgacggggaatggctgtaaatacagatgaagctttgcttgctcacctgccactcacctcctgctgtgtgacctggttcctaacaggccatggactggtaccagtccctgagggaaccctgctgtcttgggagctctataccccttgtatcaggaaccttccaccttgcaaggatatagtgcagattaaacacagcaaagagcataaatagcctagcacaacacttggatggggagctgttgctagttgaaccttcacaataacctcagcagggtagtcacggctttcctcattttaaagaggttgaaagtgctacaaaaggagttaggcaacttgcccatagtcgttgcatgagtagactgctgagtttggatttcaatccatgcttatctgagtctgtattaaccattaacttacaagggagcctaatcttactactactaaattgttttatgaccccaggaaggtgatttcctctctgggctgcagtgtttattgtggggtaagacactagcaagtggaataacgagtgtgggctgctcagagattcagagtcctaggactccaagtgaccctgattgatggtctggaccatactcttgagtgaagggctgagtcccaaaatgtaggtatctaatgcaatttcagaggcctctcgagaaagggtatatctaacccaccttgagatctcacagggttgttactagaaataactaataaaaaagcctaggacatgtccaagtgccacagtgacagatatgactatacataaattagtcttgcagaaagctacttgcctggggtcatcataaatttctgatggcgcaacacaagactgattgtatttacttttgctctctgttgggttcagaagtatgataggccagtaaaacgatttagttagctggtaaattatctgcaagattgattaaaaataggaagcgagcaattggcaaattgtcaatgcacagaaaaaagaatcctcaataacgagatccagagattaaattaatttaacatggggcaccatttgaggaggatgtttcattgaactcttgtgatattatttggactgaaatgaccgcgtgtggctgtgagtgtgtgtgtgtgcgtgaatgaagcagctttgtaacatggtgctcattttggctttcaattcaagattaggaaagcagtaaaaataatacacaagggacagcagtccttagcgctcatcattctaaaagagatcatttggtggaaattagaaagaaaacatcagccttgtaataaattactctgagtatcccaagaatggaaagctggcttctattgttccttcttctcataaatgatgtgcccagattataccatcactctaacatgattatgtatgcaaatgatgcagacagttatacaatttacaatttggctgaaattgttaaagaactggcaaatggactttgacaaatcgcaatttgaggttttaaaaatgaacttttatcacagagcaagaaaacaacggatattctgccgtgcttatgtaaattctttgggcaacatacaatagagatgcgattgactacattttaaaaactaccgtcaactctttcctgtggttgggaaatggataactcaaatattgctctggttgaatcaaagattgaattaatagggaattatcatatataccacacatggattaccaattttaaaagaattaggccaccagaaaatacatttaatttaatatttctttgatgagtcagagggcacttcaagatcttgctgtgcccccaggtcatcattatgaaccactattgatactggggaggcatgggagatagttaatgaagagatctggccaacacaacacaggaaaacagggagtctgctgttttagacatttatgtcagggtgtctccctttcaattttgatctctttatatccctagggaagcttagagttcgctactgcctttcttatctaggccagagcttggttacatcatagtaagatttctcaatattttctcattcagagattcatactggcatctgtagtcttctcctttatcaacatgtattcagtattttttttccaattaaatacatttacaaaaattctcccacccatttttctttttccccactacacatggccaccatctcgatatacaattaaacagaatgctcagaaaatatctatttgtaggccgggcatggtggctcatgcctgtaatcccagcactttgagaggccgaggcgggtggatcacttggggtcaggatttcaagaccagcctggccaacatggtgaaaccccatttctaataaaaatattaaaattatccgggtgtgatggcgggtacctgtagttgcagctacttgggaggctgaggtgggagaatcacttgaacctgagaggtggaggttgcagtgagctgagatcacgccactgcactccagcctgggtgacagagcgagaatccatctcaaaaataaataaataaataaataaataaataaataaatagaactaaaataaaataaaaaataaaaaaaagtacctatttatgcagaatggtaacaagggaattgactcagtccctgtactccaaggtttactatctcaaatatattgatgatcatttataaaggctgtcaagaacattcatgaaacttaaacccagaggaaagagccagcaagcactagacgacacacggttctagagcttcttgaccaattaaataagggcagtttcaagttcattcttctgttactgctcttttatgaagtaaacgttgttcactttcctcttaaattacagggcacaaaattagactgtggcggggtgtttaccaatgtaggatataatgagaaggctacctgtggtttcaacattctgtatttctagccagaaatatttttaacagtgaccagttggttcatttggttagtaaataggtaataataaagccaaaagaacgacagcagtaccccttgggccagttggcttcactcatttaataactagagtagacattaaggtttgactccagcacaagttagccatctagaaaataagtggctcactagagaggcgatatcagtggccagcaaataatatttgggaaaataattttgacatcagtaaaaatcagaatcatgcaaattaaaataagggaacattttgtccattaagttacttgggaaaagagaaggtgagggcagagaggagaggaaacagtcagtaataagtaacaataagtaagagacagagagaaaacccagtactggcctggagaagtgaaatagccactctaacatggcaggtgtaaattgcgccaacgttttggaagaaaaaaattggcaacagaagagccaaatgtatgtccgtgccctttgtctcagcttttctacttctgaggaatctatcctacagacttgtggaagctgtcattttcctccagaacattctctgcactatctcctagactttaacattaggagtggcgtttggatgacaaaagcctccaagagcaagctggatggttccatttttgagaaacaaggttcaaacaagcaagcaaacaacacacaaaaagcctctagtaaagaaaaaaagatttatgtctgccccaaaacgttcctagcaacattatttgtttttgaaaaagtataagcaatataataacagtgggatagttagcaaattatgttacatccatatgataaaatattattctgtaagaaactgatgtttgtgacaagttttccactgacacaatacatgtttctcatatgaaaaacagaacataaaaccatgtacacaatatatcatgggtgccaaacaacatgtgtagatggagaaaaatataccaacgtcataggcaggattataccagatggtgacaggaagagtgactgaattcttcacagttttctaaattttcaaagatttaaatgaaaataacatgttaattttcatagttggaaacatatttacatctttaaaaataaggaaatttaaacaaaatgagaaatgtttataaaatagcattaagtgacaaaagtaggagtcaagatggaaaggcacaatatgctcttatccaggcaaatatgcctgtaaaacagactgaaagtaatacactgctaagaatgctacataggtagctatctttggttggtaggattagagatgcctacttttctgtacttcccccaagccatgtattacttttataataggaaataatgaataaaatacttgggaaagaaaatgttattttgcaaaatgaatctagtgagagtgtgcagataaaacagtgaaagtctttttatcagtactgccccaaacaactttgaaatgccacgtggcagtaactcatctggtagattaataatatgtatcatccttttattgggttttgccaatgcaattgccattttttttgtaagcaaatcatggtcaaataatggcaatttcatacagttcaacccaatatatgaggaagaaatggccacttataaaattaattatcatactctctacttttatagcctcaaagccaaggccaaacaacacaaaaacaagagtttttgtttgcgtgagttatatctactaatatattagagattgaaatggagaaatattttaaaaattcatttaaaactaagcccattgcatgttaatataagtaatatatttcagtgaaaatgattgtatttcccaaataaaaataatttaggagaggaatagcattgtcttagtctgtttgtgctgctagaacagaataccatagcctgggtaatttatgaacaatagaatttttcccccatgggtctggagggtgggaagtccaaggtcaaggcgcctgcaggtctggtgtctggtgagagcctggtcactgcttacaagatgttgccttgaatgccgcatccttttatagaggagaggaatgctgttcctcacatggtagaagagcaaaagaaagcaaacccacttccacaagccctttttatagcaacattaatccatgaagcacttcccattaggtcccatctcccaacattgttgtgttgggagttaaatttcaacatgggttttggaggggacaaacattcaaactatagctggtattgttttgcatttttgtaaatctttggtttaacagaaggatgctagattctttgatctgctttgacattcaatcttttgcaatattatacatcatgtagcttctggaaaactccattgtacacttgtgagagaatgaaagtgaaaaaagcatataatacctttatgttaatatggaaattgtattgacttcagagaccacagaaacccagggtccccagaccacacgttgagagccaatcaatgttcatgactttttcagggtcatgggtccccaaaaagctatacatgttcttccttctctaagaaatgagcatgcacacatatgtacacacatttgtaaataactttgggggttcactaataccctgaagtttatggataccccagattaagaacttggcctggaaggaaggtaagaattattctggctatgtttgcatgctgaagttcccaggtcaagaccatgctcagttaaggtgcttgataaatactgtagcataaaatgaaataaaaatttctcagcaaaattagagaaatgtctaaaatcgccaaaagattaaataaaattaaatggtaaataactgctggatcgggttagctgtgctctaacactgagtcagcaaaatgcctccccatacaaacggcaagggataagggcaaactccatctttcacttctctcccgaacatcttttttcaaagaaactaactggctgcaattcaaagacagtttgaaaaaatataaatatatattttgggggtaaaaaaaatccattaaattttttgattgcattgagttgcttatcaagagtgtgtgaataatgccaggaaaagatacttttctaaaaatcaatacgttgaaagtgctgttttagggttgctgtagttgttggttgtgtttcagagttattcctattgacctgaattcaaaaacaaggtattgatttataaagtaccttcagtaaataaatgcacattctttcagctaaccctaataacctgtagcatacagaacaaggtttcaagtcagctctgcagaggtgagcttatagtgtcacaattaatcctctctcagagtcatgaggctcctctaacgtgggggaacaagagagatggcagacaagaaaaccacagaaagaggaaagaggcagaagcatcttagcttcttttttttttcccaaaagattttttcaaatgtcattttggtttcctgagcaggtgggatgcacagatagcaaaaccatagccttccaatgattgaatgatgactcatcatagtcttgtaaattatgtctctactcaactttcccattaagactgaatggtacagataagcaggaagatatctctttagttgactcttgggtccattctatagaaatagaggatgaggcccatgacccctggctttacattcaaagtccacatcaggacaatgtcgtgggttggttctgatctttctcactttgccattacttaccagccacaaatggttggttgatgaggaccatattgccttaaagccccccaactttcttcacaatcattttttaccaatggcaattgacttgcttctttaagaagcaggtgaatatcatgaaagcaagcttgagcaaagtgtggaaaaatagggtttctgggcactgggcttctttctggacttttcttgaagtcaatgcccaatgacacttgagagtgattattaagaggttatatgcttagttttgtcactcaaattttatcacttaaatgtatcaattcagataaatttatccattttttaaaaaaagaggcaaagcacagggtaatatagaaatgagcagaaatccaagagaagtaaaaatacaaagcacggggaaatatacctgtatcactaatgaaggcatcctgctagataccagtgaggctgctagatggagaaaacccctggtggagcctatttagtgtccacagtgcaggaactggcaaaattccatgcatttgtatttaaatcccaaagaatctatgtttttttttttttaaccaatcaagttttctgttctttctcttggttattatgattttgattatttaaatagatttattcctgcaaagcacattttttgggggctagcatgattctcctgcagtggttgagtggtgttttgtgaaccaggagtcttggggatggaatggcagggaggggggtggcaagtgagtagtgggcctcggcctcacacctggcttcaatcagcgcagttctatttgatctgtttttatatattgaggataggagtaagattttattagaaaaagaattttgctgctaaaaacaatgacaacgagaggttgaaagtcactgatctggggaaactatgtttagactgaaattgaccctgaacattaataattcttctgtaggaaatcagctggtgacttctctctctctctttttaaagaagtttcaagttatccatattcattattttaaaaagtacagagaaaacagataagcaaaaagaaaaaaaaaaaagcacccatcctaatcctactaccctgagatcacagctataaactttggtgacaacttattagcctgttttctttctgtgcatatatatctatacacccttttttaaataaaaaagagattaaaaactctacatactctagcacactgtttgtcacttgattttttaaatgtatattatgaacatatttccatgtcaatgaatatacctcgacttcatactttataaaggctgtgtagtatgttagcatgtagacttgatccatttctatcatacatccagtttatccattgcattctggtaagatatttattctgctatcataaacaatcctgctgtgaacattctagattgctatacagagcagagcttctaactgctgtgctctggcatactgatatgttgcaaatggtcacacgtgtgtggagatatggagccacctggatcatttgctgatctgcccccagctcatgaccgtcacctggagctgtgagctgtccctagtgtttacctcaatatactccacacatgtgcttgtctatgtgactcgtgactctaaaattcttgcagagtattgatacggagttggcattacaaatatgccctctgcagccagcccagcagactttgagtctcagggtcaccctctatcagctgggggatcttgggtaagtgacttttttgtgtgtgtccctcaatttcctcatttcttaagtggaagtaattataatatctgccttctagtaattgtattgtttaaaaagtgcatgcgtgtaaacccttcgaacaacgtcagaaacgcaggaagtaatcaagatgttaattattagtgtccttgactctttttgactatttccgagctgggatggtttctgatctgaaagacagaatgtgacctttgtccctgaagatctgtgtctctccatatggcgtaggacatagcttcccaaaaggtatgatgagagagggattctttagccctgaagatcatctggaaaggcctgagggatcagagcccctgggctgatagcacccagcctttgattactccagtgtgccaaacaaacagaatcacttttattgtgtgcaatgacttgagaaaggttgggaaacggggtcatgggctttgtgtttatttcagattttactttgacaccctgcctcaccaagttttcctttccttctcttttctctcaactgtaagcaccaattatttggcaaacaatcacaactaaccagaacttagctcgacccacatgtgcaaggagaaagagatcggttttcaatagtagtttgctgaggtaacttcaatagcattttgcaatataatatgataattaccactttttagggaaagaaaaacacgttaataatcctttacctacatctcatgtaactcttttgttttctaatacttggctggtccccgcagtttggggacattcagggggtaagtgcatgataataagaactacttactgctgaaacttgaaggtgtatttaaaacacgggtgatgcttttgtgaatagccatgttttctgtctttaattttagttgctgtttctcctagtcttgaggttttgaagtttctggctttctcctttatgggcccgggtcccatttttgctccagttgagtgcagatacatgtctcaaattctggctgaacatcagctgtcctctcagttttcagaagatggctctcctattccttccataagctgctttggtctttgttccccgctccaatctgtaagccatctgcaccctttattattaagaacatatttaccaagatttcacaactgtttaatagatacgtatcttattacatgtttgatacacctcattaaacatatgattcaatcggtatttatttaacatccagtaaacacggagacccctcagcctagatagggggaagggggaggaccccagctcagtgtcagtgtgcccctttgtcctatagaaactgctccgcacagcccagtgcttcatctttaacccttcaacactccagctcaaatgggcttgggccaagagtcaaagtcgggatgaaagcctaaactgtagcttacacacagttcaggctcccactggggctaccaggctggatgcagtccacgttctcctcatgccatctcagcaacagagccaagtgtgagctatggggtgccctgtatttccagccctacagtgtgactgtgaattttttttttcggtgacttacggtgtggccttcaatacaattcattgcaaaaaaaaggaggaagattccaaaatctcccagctgttctttcaaaccagactagatgcatcagagccctgttaaataaactagatatagaccaggatgctctctgagtctatccctctgcttcgttcttcacttgtctaatcttcatgacccttgattcatggtgttgacctcttcacacatatcccagacatctgagttcacttcccatgtgctcgagatctcttagtggtttcagttatgatacacctgagtactacatggggggaagctcaagacagaaaatacaactcaacacaagagcctttcttcaaatggaaattttctggcatgagtttctcatccctgccagcttcactttcttctaaagcagggctttggagaaacattactccattgaaatgctgaaggcctttttttttttttttttttttttttctgttgttcagggtttccaggattcagggtgaagaaatccaaagaaaccacaccaactcctctgtgggaaaacttttcctttaagaaggccacaaggcttagccaaacaactgattacaaagtatggaactgcaatgctttctgtagagggggcagggggcaatttagttcttagttctttgccataaataacggattaaaaagcttagctgatgctataaattaaaaatgtgaaactaattataccagtcccataaaagcaaaacaaccaattcataaccaaagtatgtgatgtgacagcatctactgggtatgacagctctagagaagccgaggagacccagtaatcctgcaagaatctgtcctccagcccagaaccacaggcctacttccatgttacaaagcaaaacagtagtagctatgttgttctctctacccatttttcatgacaatggcttcatcctttctccaccccttccatgcaggcccattactcaaaagaaaggctcacccataccaaaaagcacagctgcagttttgccaattcaaaccagatgggtctgaaaggcagctgctgccaagactataattcaactgggagttcctaaatgtttcaaccagccatttaataatgttctatctggagttttctccctgttctaaatatatgagtgaggccaacttggtaggaccctgcagtttcagaagagttctctgtgttgctcaatggattgtttccttctgtttgacatggccccatactcaacgtatcacaaactgctgtgttttctccacccctagcttgtcctccccccgatgctgaatgaatcactgttcacaactgatcatgtcctctgtgtataagaattattcattacacattttgcctgtgactttgtggttctttgcattaaaggtggaacttatttcctcattgtgttggtctgttgctcaatcacatgacttgacttggctaatggggagagagaggtgtgtgtgtgtgcatggacgtgtgtgtgtgtgcgtgtgtatgtgtatgctgggtctacatggagacctcaagaaacactgcatatttctgttcatgcttttatactcagatgatctcacatgagaatgatatgatctagatagtgattgatctgagaagaatgagaaagcacaactaacttgaacccatcttgcaatgtggagtcaagctcagctgattccagtcaagcacagaagaaccaaagcaggcctatagatacacaagggaaaaataaatgcttactgttttaagatgctaagtttcgggaagctttgttacacagcattattgtggcagtcgctgacagatacacttgccacctaagttatctttccaaaactgccatgggattatgttagtcccttgatttgtggcttcttgctgcttacaggtcaagtccaaactctgtgccatgtcattcaaggtccccagcaatccagctctagtttaagcatcagtttctctgcaaatccttccccaactgaattggttcccgtcctctgggtttccagagtccaccagtgatctgctgcaacagtacttgtcaaactggatatcgctagtattatatccatctccctcaaaagactgtgaactccaaagtcaagagtcaactcattcatctttgtagtctcagcatgaacctatggtaaacaaactgaatttacttagcaatgattacagcctgcctgattttgataggaaacactgatagatcatttgactacaaaagacacaaatattgtcccagctactcaggaggctgaggcgagagaatggcctgaactcaggaggctgagcttgcggtgagctgagatcgcgccactgcactccagcctgggtgaccgagcaagagtccatcgcaaaaaagaaaaagaaaaaaaaaaaggactcaaatattatctgaacactttcaaaaaagtaactaggactctgtctccccttcctctaattttctaattcaggagttcagcttcctgaacaacggtctgggtttcagtaggagacagatagtggtgcaaatatccctgaaggtcgtaaagacatgttccgaaagcatggccgtggtccacttaagttctcccttaggatttcagcctgatccttgctctaatgttgacccactgccattgcccaaatagagtgagctgaaagcaggctgaagtttgattttcccagttgatttggtcatagttttgcccgtaataatgttgctgttttccctgggctgtgactgttacagatgagtcagagggagcagggctgtagccctcagatgggtcgatgttatcgatcctcaaggctccatgtcatttccaggggatttgctaaagaagctacttatgttcctttttcattttcaccaactcattaccagctgctgcagccttcgtatgcctcagcaacacctggagaagtggaacatgaccgtccgatttgagttcagacaccttcctttgaaattcaacacaaggcaacatgcaacccaccaaaatctgagtcaaataaggaagtcaggtcacactggcccacaggggtttggtattttttgttttgttttaaaaagggcagcctggccctacactaagcaattgatcccctggcttaacttttaaattaagaccattgtaaatttgggaacttgagaagacatagagaggacacccataatactttgcaaatgtcaagtgcctctcgatgttggttacttttcaaaggtagctaggttacaatgtaccctggtaatgaaaaaaccccgtcaggcccactccacggggtttcagtcaatatacataatattattgggctttgcaaggattaaaggttgtttctctcacagcctcacaatagggctatttatttttttctacccaaggcacaaaagaagcctccctgtttacagaggagcccaggacattttggggctccaaggcggtccagacttctctttgcacacttccccctgctggtggctttgtagttaacctaaaaaaaaaaaattaaactcttttaacctgcagacaccaggattgaaaaaagccaaaactaaacaatatttattagggattgatatggtccataagtcatttctagagtatagaagctctggtgtcttccagttttattctgagagtaaaagctttttgtcactccatcctctccctccaaacctaacgggccttcagtgattccatatttagtgtactgtggaaccgcccatcctgcagaatggagcccagtacatggtatggccttatcgatatttattgacattaggaggctagagacagcacatcagaaaaattgtgtagtgtgtcacaaccatgcctaaataagaaaaaggaaactccttttttcattcaggttcagtttggcctgaatgattaaaagaaattgtagtcttaaaatctcataacagagatgcgatgattagtctgtccaatgaaacttcttggataaggaaacacaggattatgcagaatagtgctgagctggctgcagggacgacccaattaactcttttaagcatcttaagaatgccagagctttcttaaaattagtttgattttttaaaaaatataaatacaggtcaagtgtggtggctcatgcctgtaatcccatcactttgggaggccgaggcaggcagatcacttgaggtcaagagttcgagaccagcctggccaacatggcaaaaccctgtctctactaaaaacacaaaacttggctgggtgtggtggtgtgcacctgtagtcccagctactcaggaggctgaggcagtagaattgcttgaacccgggaggtggaggttgcagtgagctgatattgtgccactgccctccagcctgggtgacagagcgagaccctgtctcaaaaaataaataaataaaaaagtaaacacatacaacatgaaatttatcattataatcattctaagcatataactcagtgtcattaagtacatccacaatgttgtgcaaccatcaccatctaactccagaatgttttcatcaacgaggtggaaaccccatacctatcagcagtcattctcccatttcctcttcccccagcttctggccaccacaaatcaactctctgaatctatggatttgtccattctagatatttcacataaatggaatcctacaatatgtagccctttgtgtctggtcttttacttaacctaatgtcttcaaggttcattcgtattgaagcatgtatcagaacttcatattttaaatagctgaataatattccactgtatggatagatcacattttgtttgtccattcttctgtcaatggacatttaggttcttggatgtggtttttgcttctccttatggcaaccaaaattcacagaaacagcatacagacctatgctgttgtgattgtttctaacacgccatgttattaacagattgtactgtcaatcaccatcaataagtactagcatgacaggcactcaacccatgctgcttgatgagagttcacattcttgcctctagggctgtggttgggcaggccagaaataaagcaagaactacagtaaatattaaggaatggtgcaggcagtatctgaacatgtcatactgtagagatgccctacaactggggcaggataatactgaggcatgcccagttgacagtcaaagccctgttgcatctatgagaccctgctgtctgaggggtactgcaatttcctatcagtattttgacaaatggttctctgataagcaattctgaaataaaggattggcctacaggcagtgagtagagagtactgtgatggcttcttctggactggtcctatcttggaatcaggttggtgagagttgaaggctgcctcccccagtcagtagggtcccaggaaactgggcaagacttcttttgaaaaatatgtttggaggctgggcatggtggctcacgcctgtaatcccagaactttgggaagccaaagtgggcagatgacctgaggtcaggagttggagaccagcctggccaacacggtgaaaccccgtctctaccaaaaatacaaaaattagccaggtgtggtgacacgtgcctgtaatcctggctactcgggagcctgagtcaggagaattgcttgaacctgggaggtggaggttgcagtaagctgaggttgtgccattgtactccagcctgggcaacaagagcgaaactccctctcaaaaataaaaaaattaaaaaaaagaaaaagaaaaagaaaaatacgtttgggcattgggtatacatagacataaagatggcaacaatagacgctggggactactagagaggacaggaagggagtagggggcaagggttgaaaaactaacttttgggtactatgcttactacctgggtgatgggatccattgtatcccaagcctcctcatctcacaatactttcatgcaacaaatatgcacatgaacccctgaatctaaaataaaagttgaaattattaaacaataaaataaaattttgatattaaaaaagaaaatatggggaaagctaggtgaaatgtaaaccaattaaaaaaaaggagtgggtttccattgacaagtcagaaatactatgtcaaaggatgttaaatagatgcagtttacaggccttctcagaggctttaatattccagtgtgcaccctaaaactccaatagaccaggcacagtgtgcattattttctaaaattctttgaccgtagaatcccttcatgctgctatgttcattgcacagtttttgtgctatacaaaggcatctggtgaagggggctagtgggagctgaaatgtatgtaccctgcactttgcttgccaaggtaagggtctgtggggctgtgttcacccagaggggttgcattctttgtgtgtgtgtgtgtgtgtttgtgtgtgtgtctgtgtttaaagtttgtcttccaataacatcctcctttttgtaattttcataaggatgctctataggatagtgaagtccctgaaccctttttggtggagcacgggcgatggatgtttttgtgcatgggagggaggtgtactcagggacaacagtggtccagggaatctctgggcttatcctatatggggaaagctgtagagctggggagaagcactgttatcaagggcaaaggaatccaaagattgatctctaggggcattgcgccatggaattcattagggacaaagactcttgggaagcatagcataaccgtattgttgtaatcaagtcatcatatttgaggttttgaacttgacttgcttctgacctctgtagaagactgagcttgagaatgtgcttttctatatattataccacgtcttattttttctgcttacaaatggtatgtgtgcccatcgtataaaatttgtaaactgcaaaaaaatacaaagaaaagtcactgttaatacctctattcatggttataatttcgatgtatctattttatacatcttcaaatataaagatatattttattgttatagattatttatacttgagtatatattttattttaaaaagttgcaatcttttagtaggttttgaaataaaattgtgatctcctatctatactaatctgtaacctcttaaaaaatcacatatcacattgggtacagtgtacacagctcaggtaatgggtgcaccaaaatctcagaaatcaccgctaaagaacttactcatgtaaccaaaagccacctgttccccaaaaactatcgaaaaaaaaatgtatgggaactcccatcttctctgaattgtatgtaaaattgtgtttgtgtacataaagtactgtttctttttctgaaagtaaggtctgtagtttttctcgccttctcaaagggatcatgtcctaaaaaagatcaaagtctttggtagcagtgatttgtaaactataaagtactattcaaataaaaagaccctctattgtacacattcttaaaaaaataaaaatgaaaaaatcacatatcaatatattgtatatactttccatacctttaagtatcacttcacaacatggctgcacaatgtattattgtacagacataccatattttatttaataaagttaaatatttaattgtattttatttaatacattgttggacatttaggttatttaaaaattttccctattatacataactcaatgatgaactctttttttcacatctctgattgtttctcagagcttcttacatcttttcttcatactcctataatactgctaaccctgatgtagtcacttctagttataattatttcctaaagatgagtaagatactaagtgtgaataatctctcctgatatgagtgttatacattaagatagacaatgcaaaattgtgcatttaaagcacttagctttaaagtattattactttgccttatatcataagattttttcacagatgatatcgtctatgtaggaaatctgaaaaaaatcaacaaaaagccctcctggaactaataagtgattatagcaaggttgcaggatacaagcttaatatacaaaactcaatcactctcctatataccagcaatgaacaagtggaatttgaaattaaaaacagaataatatttaaatgagaattcctcaaaatgaaatacctaggtataaaattaacaaaatatgtacaggatctagatgaggaaaaccacaaaactttgatggaagatcaaagaagatccaaataaatggagagatatttcatgttcatggatacaaagactcaatattgttaagatgtcagttcttcccaacatgatttatagattcagtgtagtctcaatcaaaagcctagcaggtcattttgtgtttattgacaaactgattctaaagtttatatgaagatgccaaagaccaagaatagctaacataatattgaaagagaagaaaagagctgaaggacaggtactagccaacgtcaagacttaccttaaagccacagcaattgagacagtaaagtattgggtaaaaagatagacaaatagatcactggaacagaataaaaagcccagaaatatacctgcataaaaagtcaactgatctttgaaaaagaaggaaaggacatgtgatagaggaaagatagtcttttaaacaaatgttggtggaacaactggacatccaatataaaaaaatgaatctaggcataaacctccttacacccatcacaaaagttaactcaaaatgtgtcacagacctaaatgtaaaacataaaactgtaaaactcctagataacaacataggagaaaatctagatggccttgggtttggcgatgactttttagctataaccccaaaagcatggtccatgaatgaaagaattgataaactagatttcataaaaattaaaattttctgctgtgccaaagacatagtcaagagaattaacagacaagccacagactaggagaaaatatttgcaaacgaaatatctgataaaggactgttatccaaaacatacaaagaactcttaaaactcaacaataggaaacaacagtctaattagaaaacgggctaaagaccttaacagacgcctcaccaaagaagatatatagatggtaaacaagcatataagaagatgctccatgtcatatatcatcaagaaagtgcaaattacacaccaattagaatggccaacatccaaaataacgacaaccccatatgaaatactggtgaggatatggagcaataggaactctcatttactgctgatgggaatgtaaaattgtgtagcctctttggaagacagtttaaccatttcttacaaaattaaacatactcttccacatgatccagaaactattctccttagtatttacccaaatgagttgaaaacttatgtctactcagaaacctgcacacagatgtttataacaggtctattcataattgccgaaacttgagagtaaccaagatgtccttcaccaggtgaatgaataaaccatggtacacccagacaatgggacattattcagtgctaaaaaggaacacactatcaacataaatgtatattactaagtgaaaaaagccagtctgaaaagactacatattgcattattctaactacatgtcattctgtaaaacgcaaaactgtggagacaggaaaaagatcagcggttgctataggctagggaggagggagggatgagtaggcagggcatacatgatttttagggcagtgaaagtactctgtatggtactatagtggtagatacatgtcactataaatttgtccaaacccatagaatatacaacaccaagagtgaaccctgatgtgaactatggactttgggtgatactgatgtgtcaatgtagatttaccagttgtaagaaatgtgtccttctggtcgtggatattaataatggcagagacaacacacgtgtgaagacagagagtaaatgagaactctttgtcctgcttctcaattttgctgtgagcctacactgctcgaaagtgtattacaaaaagtagatttagcatcacaatgtacacataaaatagttggaggtttttcttgttcaaaccagctaccatattatgtggttatatttctttgcttgacatggagttttccaaggacaaatcatgaaaagcagatgggcctcatctgaccaagacaagtcaaggaacacaagctaacatgtctcaaaggctgtttctgagtaagtgcctggcaccatatttctagagattttgcagaaacgtggccaaaagagtctcatttataggaaaaaggactctattatctcctgacagatgaaatgctatagtagccatgtagaattgtttgctaaaaagatgtctattaggtgtctttttcaaacacaggctcatgtatggaaacctgaatgtttcaaccaaatggacaaagataatgagggtgtaacagtaactggcacaaggtcaaaaaggaaagttgcttgacgtgaacacagactaccttccacgatcttctgcttggaaaggctgaatggtggaggtggctgaattgcagaatgctctgatttagagatacctcttaaagcttaagctggttttcctaaacttcaatcacctgcctatcaccttcatgattttgccctatttctgtgtcaccttcactgtgattatttttcttgcaatagactcacactttgatttaaatagatttagcctcatcctaagagataatatctatgaaatcatgagattatgtactggctatatatttttatatatgcatacatgttaaaattaaaaaattattagtgtactgccaagtcttgtctttcacatcaccatgggtatgtattacacacttggagaggtactagtttaaagaatcctttttttgggacaaatacggaaaatatgactgtctacaatagagagtaaacatttgaggcttattattctgaacagccctataggctataaatcaagccaggttttaaaagatttgagggcctggtgtggtggctcacacttgtaatcccagcaccttgtgaggccgaggtgagaggaatgcttgagtccaggagtttgagactagcctgggcaacatagggagatcttgctggtatggtggcacacacccatggtaccagctactcaggaagttaaagtgggagcgtcatttgagcccgggaggttgaggctgcagtgagctgtgatcacacaactgccttccagcttgggtgatggagcaagaccctgtctcaaaataaaaaataaaaaaataaaaaaattgaaaagatttgaataaatgtctagagggcatatccgccacaagctgttcaggtaggggtactgaagacactaacttggtcctttgatgtgatgtcatgacccatgaacactgtgttctgcatagtatcatctgaacacaggctgaatagtggcccatatgaatttttactcccacctaacgttgcattgcttgtctgtgggctccttaagcaacagccacttcactaactcactgaactgacagtcaccgtccattccctttggaagtcctattgaccgacacctactacactccacacagtcccaggtaatatcctacactctcgagcacctgagctcctggtcccagaagctgagatgtatccttcctaggagtccaatgtgtttgcccccaagcctcttcatggaagtaattcttgttcataaaatacacgacttaatgaaataaaatataaactggggacataggggcacaaaaagagttgcttctgtgacagctaaactagctctgtggaaacactcaggtcagtcactataaatagccatgtaggcaggacaactgtaactgaaggattctgccctcagggcctcccaggtgcctcaaaatctcccttcctgtcaaagaaatggaaacaggaaactgtagacaagcaacagggagctggttcctgcaataagacagcgcggaactctaagtggatcactcacagaaacggcttcgtcctacatctaagaatctgtgagtgaatgtacacatgttgttctaagctgacatgtttaaagcgcatgctattttaaaaagtgcgctcctgctttagtcaacatttaaaattaattgagcaagtacgggctcatgagaggtttcctatgagcacgtatgaaagctgttttcactgctgggcctgaaatattaggcatatgtgtctcggccttggcctgtctcatgggatgtgagctccccaaagacagagcgtgtattgtagccacctttgctgattgcacagagaataaggccttgtagttatggatcagtgttcttacacttgaactacagtgtctttgttttcatatatttgaattcttccaaattgatggtacttcccaccttaatcttacatatttttttctcattgccaatgacatcagtctgtttgggataaggaaatggctttgattgcactgttcattcgtccaggattggctagtcagtgtgaagcagaggagggatcttctagcgccttcacgtgactgacgtatggcttggccaatgaagtatttcatactagaatattccacgaataggggctataggatagtgaagtaattcatcacgtgtatttaaagttgaatttaccgatattttatggtattagatattatttctattaacattttatgctgaaattacagaatgattcgtgagtactgaatttttgattgcttttacactttctgggacactattaaacttgatttacgttaatagcactgtaagaagatattaacaatgaatttccaaaagcacttagcatctcataattggagttaaatgacaaaaaaaatgaggagataataaagtaaagagagaaaaggagagagaaagttttgacaatattctttttaacctgtggttcttaataagatttttgcaggattgttttaggttagcaaagaatcaaatccccgatcaggagagatgacgctgatttattaaaggagttttataatacagaataaagaccaagctccaggtagagtgcagaactttctacttataggagagaaaattttctgattttcagagtaggaaggaaacttcaattaccacctttttcttccttccatggtgactagaagataatttaatttttttaagaaaaggaattgatttggtcatagctgctggattacagagaggtaggcttataaggcaaaaacatccaagctagaccgggcgcagtggctgacatctgtaatccgaggactttgggaggtcgaggcaggtggattgattgagctcacgagcccgagaccagcctgggcaacatggtgaaaccacatatctactaaaaatccaaaaattatccaggtgtgatggtgtgagcatgtaatcccagctactcaggaggctgaggcatgataatcatttgaaccagggaggcagagattgcagtgagtcgagattgcaccactgcacttcagcctgagcaacagagcaagattctgtctcaaaaaaaaaaaaaaaaaaaaaaaaagacatcgaagctgaaacaacaataacaacaattattataacaaattttatttagccttcattatgtatagactctatactaagcaactgacacctataactttatttaaccttcacaacctccctatgtattaggcactattattatctccattttaaagataaggagaatgagaaccagagaaagtaaatgactttagcacgtagtgccatcaggacttaaagccaggcagtctggctcctatacaagtacttagccatcatgctttttggagcataacaactaagttattgataatctggttaacattgaagccacattacatatggcttttgcaggccttatgtgcttttacctacaagggccccttcctttctaaaaattattaaacttgtattttatgactgtagtggtataaagataaatattaaaattaaaaatattatgtgttaaaacattttctttgacctaaaagtttactcttaaaatgagtttaaaagaaaccaaggccaggcatggtggctcacgcgtataatcccagcactttgggaggcccaggtgggcagatcattctaggtcagaagttccagaccagcctaggcaacatggtgaaacctcatctctacgaaaaatacaaaaattaaccaggtgtagtgacatgtgcctgtattcccagctacttgggaggctgaggtgggaggattgcttgagcctgggaggtcaaggctgcagttggttgtgactgcaccattgtactccagcatgggtgacagagggagaccctgtctcaaaaaacaagaccaaatgaaaaccactttcaagggcccttaaaaatgttgtgggcctgaagcactgagttactgtagatcatggagaagtcagccttggttagcatcacagataaagccaagaccagaacctgggattacgtggtctcatttctcatgacaatggaatctagaaaactatggtgacagagtaagcgtaataaacaggagataaggaaacagctggtttccttctcccttgtgtttttggaagacgtcgtggcttgggtccctgcctgctattttaggactacaactccagaactgatgtggtctccatggactttacctcaatatactcggtatatactcaatatactcaatatgttcaggattcttgactgataatcctgcctgtaagtaatagaatattagagatggtcagtattgtcagagataacaagatctgctgctcacctaggattctgacttgtgctactgcttgggaagtgattctctggaaacacaaagaaagcccaaccaagctccccagccctctctgctcacagcaacaaactggggattctgtcttaaacagaaatatgatttatccattagaatctttccccaacccagtgacactttgcttgacccattgttcttggagctaaaggacttgaggtcactctgagaaggtgttgaatcataagatttggtccagacttgaatatattttgaataaaagtaatgagggagaaaataactatctatttttagtttccaaatttttcctcaactcccatctggatataggagaaagtcaaacattacaatgtataactacattatagttttagggttaatatgttttatgataaaagtaatctcaattaaggtctgcttgaactgggtccctttcatgaaagtctctcagtggtagatagacagaatgagatttacatgcagacgttatctgaaattcccctcttttaagggcagcatggttcaaaagggactagtaactcatgcttttattcagtaaggaaaatatcgcagaaataaaggataaaatagtttccttgtaatttttaattcatctaaaatcatgtgattctagtgactttagttcataagactcttgaaagaggacagagaaccaaataatatagtctttatagacttcatttggaaattaggtattatttaccttaaaaatgattgagaatgtgaatctaggattctgctaagattacagctaacaaaaggcacaaagtaaagtaaaaagggattggtaactgataagcaaatgatagatgattgagtggatagatacatgaatggattaatgaatagatagaaaagcagatagatggataatacagatgaatgaattaatagagacacaaatggatagacaaggagatgacagataatagaaagatattcatagatcaatacatggttagtaaatgagtagcgggatgcacatggatgaatagatgacttggaagcagaataaatagttgatatataaatgaatattggtagatgaatgaatagatgctagagattgatgaatgcaagggtgaatttggaatgaaattgcagatagatgcaagggtatgacaatattatgattgtacccaactggaatggaataccaatgaagataatgacatttcttttcatggaactattttaaatagtttaactgttttaggaacgtatggactggtggcagaaaattagtcagtctcgaagagccctgaagtttcataataagtgtctcaatgatataaaaaaaatacatgagtgtgccatgattaggccacttctgaatcctccctagtgccccattctggcccatttggcctctttagaacaccatgcaaatggaggagaaaagtgacttcactgggcagcctttatgcatccttggtgatacacaaaagtcatccctttttgcctcttcttaactctgatattcacatgtaccttcatcagtagacctactcgggaaggcctggtgctataattaatccatgtcacaggcagatgtaagattggcagaatttatgagtgggtttgagctactgtgatgagtaggggcacctcagcccgtgtgatataaattcctctgctaattggattgctagagctaatcagaagccagaaaaggaataaaaaaatcagtgttcctgctgccgctgctgctgctggctgataaagcagacagctcttttcaggacaggagggcggggggagctggaattgaatcctcatgcggaggtctcactctagatagctatctcaaaggcgacacagcccttctgtcgccaggccaggaggagacagatagggcaatgggagaaagggtgatgtgagcccagagagattgtattaccaaattgcaaaaacggagtgaatggggagagatgaaaggagccgagaccaagactgggagcggggaccaccatccaatggcctgagagagctggaaggcttttctgaaatgaggtaccactccccgggacacaggtgcatgcccagcatcactgtgggatatgacttcaggaatctgaggcctcatccccaaagccaagaggcgcttgcaggagaaagccatctatatcttgtcgtttagcttcacacactcttgcgttcactttcctgaagacgagagaaccgaggggacaatgcaaatcccattcaatactagggcaagtgcaattcagggagcttagctgaactgctcaagatgtagggcaagtgagggaaaaagaccacgtttaaaacctctcacctgctggaaaaccatcagcgcatagcagctgagagggaacgctctatctgtgctcactctttctacattttggaagcagcgagggggtgataaggcaagttcgtgttcattgtcctgcataccttttcctccagggatcaatagttcgttccagctgagagcgtgaaatgtgtctaacagggacacaggttagatcctggtggtccttatctctactttgcttgtctaagtctacgccacttctccaagaagcaaatgtatccctaatattgggtttcaccacgccgagtgcccttcagttctcgttaaattccattctttgtctcctgtattcttttctctctgtgattaccacttctttgcatatttcttctggagctctctacataggctccaaagccctgccttggaggtaaatccttagcctcgatgagtaggcagcaagcccctcttgcacacaacaaagacttctatttttttttctatcttttgggcgacacgataaaaaataaccctgtatttatgcaaattgcaaagtagcgtgtgataatgaaaacaaaacagtgctggcccgcagccaagacatggcgctgacgggagctccccgaccatttggctcttgattcttcggggaaagcagctgtagagaaatgagaatacaggaccccctcctcacactcgcacaccctggttcgcacgcattccggtacccgtcacctcggagccagcgagacctgggatccaaatgcggttctgcctcctccggccgtggagcactgcagtgtcgtcctccacgagcctccctgcccctgctcctgattccctttcaggaatttacaaacattttccccagatcaatatccgtattgattattcattgtgagtgagtcgtgtgtctttggtgatccagcttgcagaggtagcaggcaaaggctgctgcgggggaaaaaaataacagaaggcgagagggacccagctcttgctgggtctgcggctgtcggcaacacagaagggaagagaaaaagagaaaagcacctcaaaaccaaggaatggacacgggtggaagagaaagagggagcaatagcaagaaaaaaggaatcgatgactggacatctggtcccagggaatctcgatggcttggaggaaacccccatcttgggtctgctgttacgtgcaggacgcaatggactttgctctgggagtgcaaagtgactcacagttttggtatctcctacgtaagagctttggggggattccttggcttgctgacaggcaaggaagacagcggcagcagtgaggtaaaacacgattacttccaactgccttgcggaggaggcgcagtcgtgcggtgtgacttggacagcttgctgctctctgatggcacgcggagggagaataattaaaaaggccagcatcacttactaagtgagtaaacacagagccgttccaatcgtgctctccagctaatgagaagctgtaatttcttatacttcaaggcaagatgagacagtgatgggttcagtggagggtgtgtttgcgtggatatgggggtggggggtagtggtggtggtagagttagatcgactaattgttggcaatgtttaagaaagggattactggaaaagacagtgaaatgatgacaggaaaacatcttggaccagagccaaaaaaaaaaaaaaaaaaaatcgaggcaaatcaagtctgcagctcggagaaaacacccgtcgctccggtgggaagctccgacgggaattgctcgatgttccttagccaaggacggaatatcgtgtgagcacaaggggacagaattagggaccaccagagtccagaggaaagagctacggtatgccagggtatacagtgatgtcatacattgagaaaaaaaatgaaaaccccaaaaccagaacagatcaaaccaaaacaataaaaaccaacctgtgtcctttcctttttatgggaggcttctgcttcagtttattaaaagcaaccctcaaatgtaccttctgatagcaggagctgctgattctctgtttgtctgcagaagctgctgcagggttactgaaagacgctggaaaaaggaggttgaggaaattaagttttccattggttgggtttctggcaaacgtgccaggcgatcgtctgccatttggacagccatgggggtgccagtttgggattcctcttctgttgtcacccagctttggcttggtgattttaatacagtgttccaaacacacatgacaaagtggggacctcaagtaataaaacgagctggattttctttctttctgggtgttcagttaactgagctaaatggttctctttcacatgagtggaattggggctctttaaggatttctgggactggaaggtcacccttttaagatatcctccttcttttctgattgaggttttaatttcacattgcttccttatttaggactccccagtacattccaagtttcctgagcaggagaaatagattttgcagaagtgagccacggagacccaaatgaggaggaaataaaccagctgtggatgacttgggcaccctccatcgcatgtgtttggcattcatagagacctgtgtctgcagtgtgtgtgtgtgcgtgtgtgaaggtatcgtggcaaatgtgtgcttgtatgagtgtggctccgtgtctatgtgtctctccgagagggagggaaagggagcgaagtcagaacaggcggaatgtttgggtatttatgtaattcatgcagagaatgttcaatgctgcaaggcagacagtcacccatccctggactctgtggctgtggagggcctatacagacctgatctgaatgttaaatgcaggagatgaaattagcatactaaccaaggatgtcaacccctcctcacaatcagtaaatggctgtctcctctctctaaagccggcacagccatgcgcgccagccacttaactatgtcccctgtcagatccttttttgtgtttgtttttttgtttttattttttgatgaaagactggaaattcattaatgaggagggaaggaagagcttcaaggggctgtaatgaaaacaaatgatcctctttaaacctcatgatggccaaagccaggcgggcggggattgctttctgctctggggttggagaataggaaattccacagacagcagaccacttgaggagatccaaagaatgatttgcttgggaatatttcttctgtgtggcacagatcggccatgaccggtgtgtctgtgttaataatatcgagaatgaactttatcttcctaactgtaaaagagaagtgttgtctaccagatgtttctccactgggctcaaggttatcaaagtttcttgaccttgttggggtaggaagtgtcttctggacttttttggccaattgcctcagcctttgaagtgatagaaatttttcttttgggctgtgcattaggccttccccaaagatagtacttgcttttattttaatctctatcatacaaagaagtacacagagaaaaagatttgatgtccacttttagagaatcccatcctaaagcagacaatgctgtctagaagctgagaatcaggcatattagccccagtatttaagctgggaaatgtttacttactttttctttctttatttatttactttttttgagacggagtctcactctatcaaccaggctggagtgcagtggtgcaatctcggctcactgcaacctctgtctcctaggttcaagcaattctcctgcctcagcctcctgagtagctgggattacaggtgcccaccaccacgcctggcaaatcttttgtatttttagtagaggcagggtttccctgtgttcaccaggatggtctcgatctcctgacctcatcatcctcctgcctcagcctcccaaagtgctgggactacaggcactttgcctacatggtgaggcaccatgcccggccactttttctttattttaaccactctatcctcagaaacaaacttctttcttcccactgtacttcactgatttggctttaaaccaggggtcataactcggaaatctccagggacctgtgcacaccagcctgaagagatgatgaggaggagtggggcttgggatgaaatggaccggagaggcactcggctctggtcacctgatgtatgggggaataaaagttgtgccatgtgttgcctgatcttccactgttccaagaggtggtagagattggtatgtgtaaatatcaaatatatcaattgtttttttttttagatagcatctcgctctgtcgcccatgctggagtgcagtggtgcaatcatggctcactgcagccttgacctcctgggctcaagcaatcctcccatcagcctccagagcggctgggactataggcatgcgccaccacgctaggcaaagtttcgtattttttgaagccaccaggtttcaccatgttgcccaggctagtcttgaactcctgggctcaagcaatctgcccacctaggcttcccaaagggctgggattataggcgtgagccattgcacctggcccaaatatatcaatcttttaaaaaccatctatgagttaagtgaaacatatttgcaaagacagttttagcctacagacactactctgtagtctttgtgttagtctaaagttcctagaacaggtgttttggcttttattctattttgtattatttaaaaatatagatattagcaaggacacggcatacgtcaagggagtatgtgttttgctggactaagagggaaatgctaatttaaaacaataaagagaggaagggaatggatgtcagtgtggcctgcatgccctgtggtcaacatcattttagcaggcatgatgtaatgccatctttctttaaggtagtgatctctggctgggcgcagtggctcacgcctgtaatcccagccctttgcaaggccgaggcaggtggatcgcttgagatcaggagttggagaccagcctggccaacacagagaaaccccatctctacaaagaattagccaggcctggtggcacatgtctgtaatcccagctacttgcggggctgaagcacgggaattgctgaattgcttgagcctgagaggcagaggttgtagtgagctgagatcatgccactgcaccccagcctgggcaacagagcaagactccaccttaaaaaaaaaataagtagtgatctctacaaagggtttttcctccacaaagggtcataactgggaagcttaaatatctaaaaagaaatgcattcacatagttttgatgcagatctacatccattttaaaaacaattagtgattagtgtcagttcaacatttttctttttcattttaaaaaatgttcttcttacccatccacagcactcttcatctcaagtgagtaagaaaaaaaagatagaaatccccagaagagagagatcctgcctgtagtttggaagaagccacgcggtacctgagataacttcaacagcaaagggcacttcagcaaatggtgaagacagcaagaaggctcctcttctcacacaatgacatctcacaatcgtgcagggctttccaatttccacggtgctcttcacacatattaccctgtttaattctcactacaaccagtgatatcggcgagacagatagtctttagctaactttacagatgagggtactcaggctcacagagagaggacttgcctaaggttgaaagataataagagacagctgcaggtcttctgggtcttaatctggtgccattttagtatttttcataggttcttataaaaaacatcctctttagaacccgtgacttaaaggtgccttgattcttaaaaaataaaattctttagagatagggtcttgctgtgttgtccacgctggagtggtcacagctcactgcagccttattctcctgggatcaagtaatcctctcacctcagcctcttaagtagctgggactacaggtgcacaccactatgcccagctaattttttttaaaagatggggttttgccatgttgtctaccctggactgagactcctgccctcaagcaaatcctcctccaaattgctggaattatgggtgtgagccaccaaatgcagcctttttttttttttttttttttttggagagaacacggtcttgctttgtagcttgagctagtattgaactcctggcctcaagctatcttcctgcctcagcctcctaaagtgctgggattacaggcatgagccactatgcccacccgcttccttgattcttgatccatgctcatccccgcctcacttcttcaccatgaggttttttttctcatagcctatgttatttgtagttatgtgcactttgaaaatacttcctgtatcctgccagcgaggaagaaccacagctaatttccactggcaaaggcagaagccatccttaacttcccattttcctctatttgttcctcctttccttgaaagtcaagtttacccatgagctggtctacatttgtactatttttacttcttcactccgctttgcatctctacccagggctatctgctttcattcctactttcccattaaaactgctctaagtcattaacaaccaattccactgtgccttcctctctgaatcattgtattcagtgaccactccctctcgcaagacgtctcctctgtcatacctggcatcattctattccttcttcatttctggttacctcctctctagcttcatgtcagacttatcttcctttattaatgccttaaatattagtgtttctgaagagggtttctgtggccaccttctattcttaactgtaaacactttgttttgtgtaatgtaaagccttggcttcaatgatcatctataggctgatcatcaattatcatctccatcccaaaccactctcctgaattcaacccaggatctctggctccctgctgttacctccttgggatggtccacgagcccttcaattcagggcaccccaaatcatccccaaacctgcctcccttcaccctcttctttttctcccccagctgctcttcaaattctctcatttctttccctatttctattttctcttttttattgtattcctatcgctcttctcttattttcctagtggcttttccaaaggcctaactgttctcatcattctcagatatgccttgcccacaatgccttctctgtactatgtctaattgacctacagaaagtgcaaatgtgattatcttgctcgcctttgtgagatccttctgaggatcccaccttcttacatggccttccaggctgttcatgacctgtgtgctgcctctccctcgcctgctctcttctaactcgtccattgcccatgctctgcttctaggtcataaaatgccccataactctttcatgcctctaggattccatatgaggttcctgcttcctggaacgttcacctcggcttccttcatttgaccaactcctcctcccctttcaagactgttccagcaagaagcatttctcccccgaccgaaacctcccatgctgggttacgtgctactgcaagaccctattcctgcttccctctcccacagcatgactccactttcacaatgaccaagttttcccatttgaccatgagacacatggaggcagagaccgtgcccttcatccctgtcttcccagcacccagcacagatcccaaaataaactgggtgcttaataaattaatattactatttttattccaagtatcataaatagtatttttccagctgtaagattacaggcctccaaaataatcaagctgagggaaatacagcgaccgtttcccatagagaaaaaaggatttcctattgggcaattctcacctacatcacttttttgacttctttcaggcgagagacaagcagtggggtggtctttaggtgtttgctgatgtggtagaaactttggagttaattagaagctctggctaaggccgaacttcctttgcagagttcctgggaggaaacactaaattaacagttcaaggttactattagaaaaatggcctgtttccctatgttatgcctcagagagtttgttcttctctctgccatttctaagatgtttccattttcctttttacctgggtaggtttgccaccctaagcccagtcattccaacacaggtgaaagctcttgaggtcagggactgattcttcgcctatcttccagcagcggtagattctggggcactcaattagtacctggtggagttgaatagtgagaaaatctgctcatcacagaagaaggaacggggatgatttcctaagttcccattttccacaaagcagaaaatggcatgagatcagtagtaccagacctccctggcagtgctagaaatatctcaagatactatgagcaatttctaaatttggaaatgcactgattcttgttatttgcagtagttatgctctgtaaagttgccacagacactgagttagtgaataccgaaccatcgctcctaggggaaatagagaattaggttcctgcaagcctctggtcacaatgttttcatcaatgaatcaatacagagcctcgttttatgtgtgttcctgttgaagatttaagaaccttattttgtgtgtgtgtgtgtgtgtgtgtgtgtgtgtatatctatacatatagttacttaacattgaactcatggccaataacactataatgcatacctgaatgaagcttaatttacacatgtgttttctttgtaagggacaccacagccttcttgtgcttaggaccaccagacggtacttttgcatcatgcttgcagggtattttcttttctttttttttttgagacagtcttgctctgtcacccaggctggagtgcatgggtgccattttggctcactgcaacctccacctcctgggttcaagtgattctccagcctcagcctcccgagtagctgggattacaggcacatgccaccatgcctggatcatttttgtatttttagtagagacagggtttccccatgttcgccagtctgatctcgaactcctgacctcaagtgatctgcccacctcggcctctcaaagtcctgggattacaggtgtgagccactgtgcccagcgttgcagggtattttaaatgacaaaatcaccaactaagagcacaaaatgtcaacaacatggcattatgaaaagaacacttgtttatagtatgagagataaaacaggaagcagacccttatttgacctcagctgggaacacacacattgggcgacttgatgttttcacctccctgcatgtgtctgtgaataatgatgaaagtgctgcaagtattgattttgaagttacaactaaatttcaatgagtaggtgaatttgcaaatacggaatctgtgaataatgaggtaatacatactatcaggatatactagtgaaagagtagagttttgcttatttccaaatagagaaaaggatcatcaaactcacagggcatttctgactttgaagtcccttctttaaattgtacaaaacatctactttctggcaaagttcatctgtgctttcttagaagttttcatataaataattggcactcaccagaagttgtctaactgttggggatggggtggtgcatttttctcaaagaaagaaaactggtttgctgccaggagaggcaaagactaggcaattgatgagaccccactggaagctgaaggacctcccgctgtttatgatttaaagtcggccttggcgaaatgacagatgactcacgttaggcacctgtgcccatatacagaggattatacatgatagtctgaaaagtattcttttgagctaaatcttgccctttttgagttataccatcatgacatttcatatggaaagcagctgcttagaaactcatttttgctttttgcttattgagtcccatcttgttgcaaagaatggatacagaattctaaaacgcaatgctacccttttcacactaaccaaaggcacagaggtacatgtgttttagatgtcaggaaagggggtcactcaggcatgcagagtggactgagaggagaagtgtagtgagattcagaaactaagagtaataaaaggagggttgggggccgggcgcggtggctcatgcctgtaatcccagcacttttggatgcccaggcgggtggatcacctgaggtcaggagttcaagaccagcctgaccaacatggagaaaccccgtctctactaaaaacacaaaataagctggacatggtggcacatgcctataatcccagctacttgggaggctgaggcaggagaatcgcttgaacccaggaggcggaggttgcggtgaagcaagatcgtgccattgcactctagctggggcaataagagcaaaactccgtctcaaaaaaaaaaaaaaaaaaaaaaaaaggagtgttgggcacttcttactacgtcttattaaaagtctatttggagttagttccatcaggatcagaatctctgctctcttattagtattgtgatcctaaaacgttgagtgacccctttgagaactgctctctcttctgtgaaatgggaccctaataccaacctcttggaatcactgtgaggcttaaatgagataacaatgtcaagtgctgggctctaagtccagcagaaagttggtaatcattgcttttgctagcatcttctgggttcctaactagcaatctgactttttgggcatattcatggagatacggaagactggagttgaagagacctgctctgggtcaacttccttactttatagaggagaaagtaggctgagtggggtccaaccagcacaagtatcacaaaggtagtcagggcagaataagaaggagaacctagctccctgaagcccagttcacaattatacagtagggtcctggtgcctagatttccactccagatcctccttctacaactatgaactgtctgccacccccacacccaccccattagcctggtaactactgctccatgggttagtgtcttctttggcagaaagacttggtgctacatcagccaagttagaattttttagagcaggaaccactgagtgtgagtttttcgtgtctcttgactatacataaaaatagctatgaacagataatactcacagcatattaatgtaagacaaagcaaaacggatcacagaagctacagaaggaatgctccttttaaaagagatcaattatttcttcagttctctgtagcaatttgcaagatgctcccttggaaaagcccacagggaaatgctgctggatatataaaccctaaagcttataactgatcatgcaataacgagacaagaaagctgtgctggacaaactggatgaggctggttaatttccaacaagcctgtcttaacgagcggagtacaggcttaacactggccatttcaaggtgccagcaaccttgccatcagtgtggaggtgtggggtagagggtaagatagcacagtcctggggaagccattgcagcaactgggccgtgctatggaataatgaatcacgaggcatttgggcaagaagttataaccagaaggacgtggcaatagcaagacaaatcacaatggacttagtgggtcctgacagtgaaaaggaggtcagaggctggagtgtgtggttaaatgagtagggtctaccactgtgcagttcagccaggagagctgagtggtccagacagctacagaagcaccaagattggagctagtggcacagctcaggctggctcacctctgctcagctaagttgggttatataagcaggtatcaacattttgaagtggttatataggcctggtgggatgggtgtcccttcgtccacttcatcacataagagataaatctttgctataaattgctcatgcttcagcaaagaacaatatttcttagtgggtattggaaggtctggaggcaacaggcaaattctatttctccatggctgtgtcccactcactctctattcttcacccatttttgtcctcattgtactcatagccaatcaaactgaggatccacaaaggctgatatcagatgtaacttcatcagaatatcctccttgtgaaagatctgtacctatatttaatctgccaaggtaataggtttaagtgaaacacagctgacatatccaacccactaagctattatatttgcattttatattgaacatccctgtaatattctcgttgctagatggaactgacatttccatatgacggtaaaggctaaattgtgaattgctttcatcggggttttgcttcagtgatttcaccacgctatagacatagacaaaaaatcacaacaaatacacataagtatccaacacgttttgtgtgtgtgtgtgtgtgtgtgtatagtctgttcagtggcttaatttggacttacgcaacagatcacccacccagaatctaattattcagcaaccatgttacttatttggaattgataataataataaatgttttctaagaagctggagaagctgtcactgaagtgacatcatggaggttcagagatggtagagaatgccggtagagaacgcctcaagtgcttggtctcagttggatgtgaggtctgttttaagaatggtacactgatggccaggagcccttggggatcatgcaccatgctaggcagccctcctttcaaagaaaggcttgtgaaatcaggacttgggatcttagatcttttttagtgtgggatttgcaggaaagcaagtttggcctttgcaaggatgggaagtggcagcactggtccatcggaggagggtttttgggaatatttttgagtggcagatgaaggattctagaagagtattcatcctgaggagagggtcagacacacaggcttgacttaagaaggatgacacagtaatcaaaggggtgggcggatttggggtacaggacgccttccactgtgaagaagacagattatccttctctcctccatcctccaagccacatcccagcacacaggctgaatcccagtgacaagtgaaagattcgagaatgattttcacacaaagcctcttcgagggacaggacatgggggccagaagggctttgggaacaaggcaactgattatggcataacagtcaaggaaagagattctttcccagctatggaggagtttccaggctgtggaaatgccaaaggtgaaaatgacaaagtggaattgagggaatttcaacccgaagcagacacctgtgctcatggccataccagccccatgtccagcgggatcccttagtgactggaacctgtgatatcaccaactatggcagcagggagatgttggcacacagtgatgccaccagcttgaggaaggacaggagagactgcctttgcacggacagcaaccaggagatctcccagcagcagggacagagcaggatggggcaccctcacaaagactgatacatggcagaggacttagaaaccagcaggggttgagaagactgatgtgaacacatgtgacatcccctttcccagttcactccccagagtacctgggggagatttggagcagaagtgggggcttacaattgcaggtggaggtcaaagccacctatattaacagagcccagctctatatagctttgaccagagaaactggtgatctcagcaacctattcttggaaactctgtgaagggaggatgggtggtcaaactccacttgtatggacaatgataactaatttagaaccttgcgcttacatttcccccaaaactcatagcagtcaccacactgccctctcattgttgatttactcatctgtctcctcttgcaagatgtaagctccttgaggaaaggaactatattttattcatcttcacatccccacttttctgtttttttgtttgtttctttgtttaatacagtctcgctctgtcacccaggctggagttcagttgtgtgatcatagctcactgtagcctcaaactcttgggctctagcaatcctcctgccttggcctcccaaagcactgggattacaggcatgaaccactgcatggggcccacattccaaattttcaacactgtgtcaggcaaacagcagacactcaatccaggcatgttggatgaataaatagatgatgccttaaaaaaatagatgatgaataagtcataataatgagatggcctcaaatgagaggtaggttatgtaaataagcaaagatggtgtccaaggatgttgttccaaagacgtagggctccttctggggaggctgtcatggggagttaggaggaatttgtatggtccagagctggcccctacctgggcccttccagaaccccatggaaactcatcagattgtagcccctagtactgatctaggtgttcttgaggtgagcagagagggtagctgggccacacctcaactactttaaactcttagtaattgaagaagtgaaagcgtaagagtaagggtcctagaaggtgagaagagatgacagatgaacttgtcctgcctctttaggtctgggaaccttaagagggttgagtccttgggcgtggaccatgataggctatacttcagtgagatgtgggccttgggctgctgtgggatgtgcacagagattattccacaggacagaggccattcccctgtttccttctcttaggatgtagtaaggaagctccactcctgtgagcagtcccagggtcccagccaaggtttcttggttatgcttccaacaagggtggcactttggccagaggagcttcactagatgacagggcagttacatgtctgttgattccaagccgcagagttgtgaccttttaggagagagccgaggcattatgagccaggagtgaaccatcctgaacaccaagcatggctggcagcatcaggtgagtgctggagactagctcttccctcctggccaggagcttgggagaatgaggcttggccaatgaaacgcacataagtcacatatctatgaggtctctgtccccatccaggtttggagctatgaacacaagactcaggatcagaagtctgtgggtaatggttcagaatccaggctgactgcgctcctaaacagccagctgggtcatcgccagccatcgaaccccgaggtgctgggtgggccaggcttttggaagctgtctcctccatgaccatagcctcataatgaagggggtctttcccagctgaacatatctcttgattaatctctatttgctgttcatctatatgtatttaaaaaaggagagagccatgataacacaatgtccttctaaatgctcgtatcttaaagcaagtctacatattctttagatacgatgtgcttaaaataagcagcaatttagggtacactttttcacttttaaaacttgcaactgacttcggttcctatataataaagttttatacaaactagtaattctaaaatgattctttcattcttgactggttgagaaactgagggttgtagaagttttgtaaagtaatatttagtgtccccagaggaagttatgtccctttatactccttcatgtatgtgtgtatttgcttcaaggttttcaggcactgagtgccagtgtggatgtatatgtatatatgtgtatgtgacacgtctgtgtgcctatatgcgtgtgtgtatataatgtgcatatgtgtctgtgtgtctatatacctgtatgtggagtgtatgtgtatgtgtgtgtactgcatatataatgtgtctgtctatgtgcctgtatgtggagtgtgtgtgtactgtgtatataatgtgtctgtgtgtctatgtacctgtatgtggaatacatgtgtgtgggtatactgtgtataaaatgtgtctgtgtgtctatgtacctgtatgtggagtacatgtgtgtgtgtatactgtgtataaaatgtgtctgtgtgtctatgtgcctgtttgtggagtgtttgtgtaggtgtgtgtatactgtgtatataacgtatttgtgtgtctatgtgcctgtatgtggagtatacgcgtgtgtgtatactatgtatataatgtgtctgtatgtctatgtgcctgtatgcggagtgtatgagtgtgtatatactgcgtatatgatgtgtctgtgtatatgtatttgtatgtggagtgtgtgtgtttgtatactacgtatataatgtgtctgtgtctatgtgcctgtatgcggagtgtatgagtgtgtatatactgtgtatatgatgtgtctgtgtatatgtacctgtatgtggagtgtgtgtgttcatatactatgtatataatgtgtctgtgtgtctatgtgcctgtatgcggagtatacgtgtgtgtgtatactatgtatataatgtgtctgtgtgtctatgtgcctgtatgcggagtgtatgagtgtgtatatactgcatatatgatgtgtctgtgtatatgtgtttgtatgtggagtgtgtgtgtttgtatactatgtatataatgtgtctgtgtctatgtgcctgtatgcggagtgtataagtgtgtgtatactgtgtatatgatgtgtctgtgtatatgtgcttgtatgtggagtgtgtgtgttcgtatactatgtatataatgtgtctgtgtgtctatgtgcctgtatgtgcagtgtatgagtgtgtgtatactatgtatataatgtgtgtgtgtatatgtacctgtatgtggagtgtataagtgtgtgtatactgtatatataatgtgtgtgtgtatatgtgcctgtatgtggagtgtgtgtgtatactgtgtataaaatgtgtgtgtttgtctatgtgcctgtatgtggagtgtgtgtgcgtactgtgtatataatgtgtctgtgtgtatatatgtgtgtgtgtatactgtgcaatatgtgtgtgtgtttatgtgcgtgtatgtggaatgtttgcatatgtgtgtgtatactgtacatatgatatgtgtgtgtgtataagggcctgtatgtggagagtgtgtatgtgtgtgtggttgtatactgtgtataaaatgtgcctgtgtgtatatgttcatgtgtgtgtgtgcactgtgcatataatgtgtctttgtgtctatgtgcctgtatgtggagtatatgtgtatgtatgggtataatatgtatatgtgtctatgtgtctatgtgtgtgtgtagataccgtgtatatgtgtctgtgtgtacatgtgtgtgtgtactgtgtataaaatgtgtctgtgtgtatatgtgcatgtgtgtatgtcctgtgtatgtgtctgtgtgtctacgtgcctgtatgtggagaatgtatgtgtgtgtgtgtgtgtgtgcacgtgcacgtgtgtgttgtggctcaatggaggctatactggatgtctcccctatgtgctgagtatgcactagaatggaacgtctgcttttctagaccacatgagtaacgtcaaagaagttgcattcgatccttatattgaagtttttttttaattgaaaaacatgtttttattccaaaagactgagcaggatggtattttaaaaataattcaagtaatttaaatttaagaccctaaaaaaactgtccagtctgtggtccaaatctattctctggcccagcgcccaaggcattttcattagattgggaattagatacgttttcattcacttcaaacttttgtgctcagtgttttgttcttcagagacaagctcacaagtgtcagtggtcacactgacctcaataatacgcctcctttccttgaataatctatttcagttgcattattgccacttaaagatggccttgtacttgcagacacattttcagtggatgtatggggaatgctgataattcccctacatgtttttgcctctaaagttagtaacttgtttgaagaaaatgtccctaacttactttctttgaagccatttgcaaaaagaggctatcaaaataattctctaattttttcttgctattattaaaggagattgtattagtctgttctcatgctgctaataaagacatacccaagaatgggtaatttataagaaaaagaggtttaacagactcacagttccaaatggctggggaggccttacaatcacggcagaaggtaaaaggcatgtcttacatggcagcaggcaagagagaatgagagccaagtgaaaggggaaaccccttataaagttatcagatctcatgactaccacgagaagagtatgggggaaaccgcccccaagattcagttatctcccaccaggtccctcctacaacacatgggaattacgggagctacaattcaagaagagatttgggtggggatacagccaaaccatatcagagattttgtcacactatactaagatttccttaggttttaaaatttcattagtgaaaattctactgttgtatcttcagcaaatagtactgacatataagtaagaaaaaaaacccagttaactcaaagaaaaatgggcaaatgaattgaacaggcacttcacacacacacacacacacacacacaaaattcaaaagaccaatcagtgcaattaaggaaatgcaaattaaaatcataacgagggaccattcccgcaactaccaccttggccaacattgaagtctcacaataacaagtgtcagcatggatgtaaaggatgacagcaacttcctacactgttggtgctagttggctcatacttcagtgttgtctatgtaatgcagaaggtacttttcaaatgattctgaaaccaggtccttatttttcttttctttcaatgaaggcaggtgtactttccccacaagtctgtgatatggttgcactgatagcttcttaccctttcaggtacaataacatgttttcatcaaagtaatgtatcccctgagtactaatacataaaatagccacatatcatgatataccaagcatggtgcttgtacacagtagatgctcaatgaacactaagttgacataagcatatctgtcatgtaataaaacattcctgaaacaagatgttatcaattgctatatattctagccgttcagtttttgtggatgtgtgtgtgtttattttttgttgtggtaacatttatataacataaaatttgctattttatccatttttaattttacaattcagtggcattaattacaatcacaatgaataaccatctagttgtccagtgtcaacattcattttattttatttattcatttatttattttttgagacggaatctcgctctgtcacccaggctggggtgcaggggtgcgatcttggctcactgcaagctccagctcctggattcacgccattcttctgcctcagcctctcaagtagttgggactacaggtgcccgccaccacgtctggctaatttttttgtatttttagtagagacggggtttcaccgcgttagccaggatggtctccatctcctgacctcatgatccgcccgcctcaggctcccaaagtgctgggattacaagtgtgagcctttaagccaccgtgcccagctaccctcattttaatatgtgaattgttagagtcaacttttatatttcaaatttcttcttttttcccttccttcaatacagcccttcctccctcctacatttcatcttttactatctttgccagctcctggtctcatctgcaatctgagtcatgtgtaccattatttgtttgggtgaccagcgatctctgtgtcagaagaatttattttcttcttcaatttggcttgcagttgtccagtagcagaagctgctacattaaactacgggcagttaaaactcaaaaaagtgtctattcttaccaggaataatgtagactcttggtttcagaatcctctgagacctctcacagataatccaaagtaccaaaaatgactagcccaaagtcttagtgagggtactatgggtactaactcaccaactgtgtacagtccccaagttagtctctcttgctaaacagtgaatcactaagctgtggataatgttacaccacaagtgtgataaaacgataacgatgatgataatgacaacagcgagcacggagcactgttaggggccaagcgtggctctaaatctgttacgtgtattaccttatttggtcatcatgataatcccatggcatatgcacaattactagcctattttatagatggggaaactgaggctcagagaagtgaatcattataatcccagaaccttggtcttagtcgctacaccgtgaccccagatgagtagaacccagaagaatgctcttctttctcattctttctggaaggctggatattccaaatgaaaaacagatagattaggttagggacaagagtaaaacacacattcacacacatacacaccacacacacacatgcacacacacatacacaccacacacgcacacaccatgcacacacacatacacaccacacacacacacaccatgcacacaaacgcacacaccatgcacacacgcacacaccatgcacacacaccacacacacaccatgcacacgcacatacacaccgcacacacgcacacaccatgcacacacaccacacacacaccatgcacacacacacaccacacacacaccatgaacacacacatacacaccacacacacgcacacaccatgcacacacacataacacatcacacacacacacaaacacacacacctctttatgtctttgggggtcagtgaggggtggggagggagcttggggaattagccagtcagtaataactgctcaaacaaaaacatccagaaaaaatatggcagtttagctgggaagagattatttttagctgctgggcaggaagctgttgagtataaaatgcagggctactgaaggatttcaacacaaaagggacataatgaaagctatgcttttaggaaaataaaactgtgatccatgagtatgagggcctggaagaagaaaagacttgaggtggaaaggccaatgtagaggggcctacaggaatgtgcagggcaggcattgacggctggagctggggtagtggcatggggacggagaagctgacagagaccctgtagaagcagaacaggtagagcagtgggtatggaagtcaagttgactgcaagagtttaacctgaatggctaacaggccgtgggggtctcatgaagagaaataggaaagctgggagaagaagggaatatgggggcggaagtgcaggcacagaatatgaggccctggtgagatgcacaggggcactgggagtttaagttcaagaaggaagtcagagccccatgcagaagcagcttcaaaagctcagggtgggaggagacgggctacggctgagtgttcggtgagaaaggggaggagcagcaaatgtagaaacatcggtcacatggactgacgatgaagaaagaagagagacgtcaggacaggttaaaggggcggaaggagccagagaaagtctagcagaggataaaggagccaatgttcatagaccaacgggcagactccagtggagcagagagaaagaaaatgcatgagagagaaaggaacaaccaatgcaaccaaagtatgctggcggaaggccaccggagtccaaagagaggggagcttagagagaatgaccttttctccagcagagaaagcagagcaggaaagcagttgtggaagcagaactgattgacaacctccagctgtctttgcacctttggattcacccagcattcattgcaggtcatgctgctcccaggctgttccaggcgatgactgagcacggcaaagtgctagaactgcaccattccaccctcaaccccatgggactcctctaacaggcaacgtttgctcaaggactcctccgtggcctggctgagatgtaaagaaagaaggagagaatcaagaaacctacagatacggagcagggaggtgaggaatacttagggagttcatgagggaaggctacgtccagaaaacagcaagagtgtgggtgtaatgaaaggagaacagggttgcaataaagactgtgagaaatgaaatcaatggaaagagaaagttaaatacaccaaggaaccctgaggaccacctgatcttggagaacacacaaatggtgcatcagttggattggttgtatgattttctttctttctcttttttttttttttgagatggagtctcgctctgtcacccaggctggagtgcagtggcatgatctcggctcactgcaagctccgcctctcaggttcacgccattctcctgcctcagcctccctagtagcagggactacaggcgcctgccaccacgcccggctaattttttttttgtatttttagtagagaaggggtttcaccgggttaactaggatggtcttgatctcctgacctcgtgacccacccacctcggcctcccaaagtgctgggattacaggcatgagccaccacacccagccggttctacgattttctttataatgcactgtgtaggcaaggagcagagacagaagacacagagtggatgtcactctggtttgggagattgattatgtggccaacagagggagaaggagttaaggtccttaaaaggcaggttagaaatgcaagaagactaagagaaaaaaaattgcctgctaatactggccttggaggtgtccagttcaaatctccatctaagataagctgctctggaagcagagctgattggcagcctgcagttgtctttgcacatttggatccatccagcattcattccaggccacgccactcccagcctgttccaggtaatgactgagaacagtgggggtaccagaactgcagcattccattcccaaccctgtgggactcctctaacaggcaatggttgcttggggacttctcattggcccaggtgagatttttctctgaattacatacacatggtctgaggcacttcttaccggatccatccttcccactatcctttcacaggtgttggacttgtgtagcaggttgaagctctccctgcccactccagcgccctttcactttatgattcactgtaaatttcctgcaatacatctcttgcatgtctaattgttttggcttctgcttgttggaggttctgaactgacacaactggaattgctaataattcatggaggggttagtaactgaaaagtgtagtcagtgaggtgtgactacaaagatgtgaggctgatgggaaagaatcatgggattcttttttgaaataatgatagattcacaggaagttgcaaaaatagtacagaatcccctatactcttcacccagcttcctccaatggcagcatcttatataagtctagaaggatattaaaaccaagaaattgacatcgatgtaatattcacaaccagtttatatgattttatgcaatcagattctcatcatgtttttgtctcatagaaatattgatctcatcttcattgcaaaaagtcacttaagtaatagtttatttctaagtaaactagctctataactgcaaggtttgtaagacacataaataaagctgcaggtggaaggggaaatagaatatgagagatgtctactgaggaaagaggtctccatccacctgtttatctatccatccatccatccatccatccacccacccaccatccatccatccatccacccatccatccatgtttgctaagcctttccctagtgtcaggaactatgcactttctattgcactgagatacgaacatcaaaatggtagcagcagctattgtacttctgtttgggcccagatgcaatgaggaatcagggtgactagccggcaaagaatatccagatcagtcctgagattgtttccacattggcagtaattcaactgatagcaaccttatgctcaacggctaggatcatacctttttatgagtcattgtaaagtgccaagggcgttgacatatacttcataaatgctaaatgataacaagccagtgaacctagaagtattggattcagtatttgagacattaaatccaagttatgctgttctagaaacaaggtaaacaaataaatcaaccccaaatcaaataaagcccacatccatccccagccagcactgggtgttgtatggaatgctctttatgggtgagtggttatctcatgaaggggcacttgttagtattttacctgacagatcacacacaatgccttgcctgtgatttgggagaagagttttatatccagtccacagtagacaacagcaacactatattcttaaggctccaattccctttatttgatgccagaaaataatgtctgctgaagccctggagaagagtaacagtcaccccactgagcaattagactgatcctggcagggagtctctgtaggcagtactgggagacactgtttgtatttcaaagccaggatttagttttccttaaagacgtaagtctttttaggggtccctgtgattccttgagggtttaggcacacaatctgcaaagcctgaaatgccacataatcctgtactggctactgaactggatacagcatggtctgagtggttttctgattcacagcccagagctctgaacatggcctggtgctgtttgatctggggtctctgggcatggccccttctctctaggagtctgccgtcttggttgcacatacaaacatgatttcctaggactcacattcccttagtcatttcacagtgatgacaccctgaggagcaaagcccaactttacatagcaaaatagcgacggcaaagctcattgcaaattaggaggcgatgaccatgacatctcagggagtgacacagactgacaagatcacgctcgaacatcgtctaggaggagatgccattcttcagtggtcacttccaaaacaattttgctgtcattcaattgcagtcaagggaggcagagccaatgagcctacaccagacaactagatctgccaatgaagtatcgagtagaggactacagagccaggaatcaaaaggtaatacagccatcagatgctgaccttgctacattttctacaaatagaagatgattctatttgtagtttctgccagtttctgcatggtgcaggcctagctcatcacgttttatagaattgaatgtacatgtgaacaataggatgttttcaatgtttacgatggcggttctcaaatattactgagcatcccaatcacctggagacttcaaaaaaagcagatttctgttctacaacctcagagattctgacttggtagatctgggatgaggaagtttttagcaggcactccagtgatgggagcagatggcctgtccaccatgcttttggaaatcattgctttaaatcagtgtttctcagtctttgcaagggtgcaatgtaaagagtttagggaaataccttcaaaataatccagtttgaatttcttattttgcagatgaaaaaactgagggatcaagtaactttctcaaggtcactcagtcacaagtacaaagttaggatgataagcaacatttaatcatagtgccctttgtaccatttcatttggtgaatctcctctccatcaagtcctgttggacatgtacacaagtaagtaggaactagaatgcatttggattatcatccaaatgcattataatgatactatctaaattataatataattataatgatgtggataatttttatatcattgaaacaactggtgagaacttcagtgttgccaaaacaaacactagaaaaaatgaattcagaaagaaacggcacctaccttctccaaatcgagggtgaagatgaagatagcaaggactcaaagttgtcctgttaacaagcacaacgtctgggttccccaaatcagagtctataacaaagcaaaaagtaaatagtttcaaaaaactatttttggtacatattcctgatactgtatcaaaacaacagtacatgctttccacaagctgttctagagtcaaactagattgaggtgttataaatatggtcatcatttctaggtcaatacctcacttgactttgtgtcgccattgtcagtttaagctgaagagttctgtgtctcagcaaatttcagatgtgtcttgacaagggccattggaagattagcccatggacttgactctgaattgttataatagaagaccccctcagacatgggatatgaagctctgagaacttctgactcatttgtttggatcccctgttagaagagagtgaaaactgaatacaacctcatttcaaatgaatgggaagtcagagaaggcaagccaagaagagtgactaggtctttatgatttcagagtttgtatttgtactcattgatgggttgattgattgactcattcattcattcaagaacgatttatgaaaacttttcgtgagctaagcagttcttctattcagtaagatggtaggttttacccaatgtgaaactgattggctgaaaggagggtaaatacccataattagttattaatcctataataatttagaagaaaggccaaggcctaacaaccttacaggttggttatacaggcaagagcacttaagtgggagtaaagtggcctgggtcaagttctgggagaccttcggctataggaaggtttctcaacttcaacagtagatacttgtgactgaataaatattttttgggtgtgtgggctgtcctgtgcactgtaaaatgtttagcagcatttctggcctccagatgccagtagcatctccccaccctccagttatgacaaccaaacaggtctccagattttgccaaatgtccccattaagaaccactggagtacagtagtaactactattttttaagcaccttttaggggcattgtgccagggtttaatatatatcttcacattcagtcttgacaccagcttttcaaacaagcattcttatttctattcaaaacatggtgaaactaaggtccagagatgttaagggaatcatccaatatcacacaattggcaagcattggaaaagatttgagcccagaattatttgacttcaaggcttatattcatcgttccctattattttgctatgacatatatatatatatatatatttgttttctgagacagggtctcgctctgtctcccaggttggagtgcagtggtgcaatctcggctcactgcaagctgcacctcccgggttcacgccattctcctgcctcagcctcccgagtaactgggactacaggcgcccaccaccacacctggctaattttttgtatttttagtagagaagaggtttcacatgttagccaggatggtctcgatctcctgacctcgtgatccgcccacctcagcctcccaaagtgctgggattacaggcgtgagccaccgcacccggccactatgacatattttaagcatttggaaaagtacagagaataacctaataaagacctatatatttagaactccattttgatcactgctaatattttctccctttgctttatatctatgcttttggacaataaaatggtataaatgagatggatctttcttttagactttctcaattctttctctctcacttcttcccccaaataaccattctactgagattgctgccatgccgttcccgggtaagagtttacattttcttacatgtacctgagtagtctcataaataatatatagcacttgaagaaaactacataaaagtacaaattcttgtgcaatctgttttctttaaactcaacgttaagtttttgagttttttctatgttggagctacggtttcaattcctttattttaactgtgtgagaataaatataccacaatggcttgacatttaggttgtctcctgtttttcactgttacaagtcacagcgcggggaacatgactgtgtatgtgtgtgtgtacacacgtgtgagcgtttccctaggaaacacagctagatgtgggattcctgggttgcaggatgtgcatgtcttcaactttattagatattgctaaattgctctccaaaatgattgtactaaattacactccctccaacacactgtaagattattcatttcttcacatccttgccaacgttcggtattttcaaactttataatgtttgccagtctgattggggtgaaatagcatataattattgtttcaaaagcctatgttcttaaccactactcttactgtctacgcttcttgaagcttcagttatgtaaaatggagaaaatacctttttcgatttcttggagtagtaataaattctcctggtgtaatatacgaatgcattttgtaaatatgaagtgccacctttgttcattgctggcagtggcagagaaaatgtgcagtttctatagcaggcaatttgatgaaatctatcaaaatttcaaatgcacatgtattttctttgaacgtaaaaaaataatttcaaaattatagaaaaggtgcaaaaatagtgaagagaatttctatatacccagattgtctaaacattaacattttaatcacatttgaattataatatttatgtgcatgtatattatatgcacacgcattatttttccaatgatgttaactctgacaattttctataaacattctgctaaataaccatggaaaagttgtcaaaatcaagaaattaacattgctataataccattacctaatttgtatatcttatccaaattttttcaactgctttactattgtccttaaccgtaaaataaattttttttttcctttcccaggatccaatctaagatcattcattgtactgagttgtcaagtctcttcaatttcatttagcatggaataattctttagtcctttttttctctttcaggaccttgacatttttgaagagcgctggtgagttattttgaagaatatccctcattttaggtttgtctgatgtttcctcatgattagattcagggtatgcatttttgacaaaaataacatggaattgacgttatgtgcaccatatgtcagtttgtcccaatactggtgatgccatttcgattgcttggttagagtggtgtctgctaggtttctattgtcctttttgtaattggtaagtatctttttgggagatattttgagactctggaaatatcctgtttatatcagcatggactcatggatttaatgagttatactgtgctactatcgatgtttattttgatgcacgcttggccagttgggaccccttcattcttgctcctgatgtgtgtcttctgacatgtccccatttttccgtgagcatttccttactttctggcacagtaagatgtcccaggttcatcttctgttttcccagcttctgtcctggaatgggccattttccattgaagtagagaatagtatttagaaaccaagatccgggtgctaggcatgttctttgttagtggtgcacctatctggtttttttttttttttttttttttttttgagatggagctttgctcttgccgcccaggctggagtgcagtcttggctcactgcaacctccgcctcccgggtttaaacaattctcctgcctcagcctcccgagtggctgggattacaggcgcccaccaccatacccggctaatttttatatttttagtagagacgggggtttcaccatgttgggcaggctggtctcgaactcctgacctcaggtgatccacctgccttggcctcccaaagtgctgggattacaggcatgagccactgcgcccagcctatgcacctaacttttaacctagcaatttctctttcaagaattcttgcagcagatatgcccacacacttgttaaaggatttatgtgcaaggttattaactgcagcattatataggatagcaaaagattagacataacctaaagatctattaataggagactggttctataaattatttgaatccatacagtggaatattatgtatccataaaagattaataaattgcttcaaaaatatattgttaaactaaaaaaaatacaactttgtgtctagtgtgttaccatttgtgcactactaaaaggagaaatatatatacagttacaggtatatgtctatatgcttgctgataagtgcataaaatatctctggaaaaatgcacaagaagccaaaaacattgactgtggggaagaggattgggtagcatggggaacagagggaagatgatgtttactatgaactttgttgtaccatttaaatttgggactatatgaagtattaaaaataaaatactataaaacataaaataaatatagcattaataaagcattattttaacctaaggtattcattgagaactcaaatatcagaaggggaattctgttttccaagaaaattggctagctaaaagtgaaactccaatttgatcactattcctttgtataaatataaacattcctgtgattgttttttttttttttttttttttttaggacagagtttcactcttgttgcccaggctggagtgcaacagcacaatctcggctcaccgcaacttccgcctcccgggttcaagtgattctcctgcctcagcctcttgagtagctgggattacagggatgcaccaccacgctcggcgaattttttatttttagcagagacggggtttcttcatgttggtcagactggtctcaaactcctgacctcaggtgatccacccaccttggtctcccaaagtgctgggattacaggcgtgagctacggcacccagccctgtgattcttttatgacttaacttctccatctgtaatacggtataataacatcactaacccatatagcagagaaaatgaaactgaagcagtagaaataagagaagcagtctaaaaacacaaagtgccaggctactgtgactattaataatgccacattttcacatttaagtgaatttaatcaatatttgtgaatgaaagaatgaatggatggatgggtaaagttataggagaacaaagatgggaggagaattaggttgaattgcttgagtttcaagaaaaaccttttaaaagcacaggaataaatttaaggagcagacttaaggtagatagattgttttaatgcattttgtgatcccatacttcacataagaattgtgatactccagggaagcaacacagcctagcagctgatgccatggcttttagagtcaggaaacttacactgatagtccaactctgccacactagttgtgtgacctggagcaagttacaagttattcaacctctatctgcctcagtttcctctagagctagaagggttctcagaggtgatctaatatgtgtctcttattttccagatgatgagacaaggtaaaaaaagggcttgaggagacaaagtggttgcccaaggtggcatcatcaaccagaagcagatttggccctagaacataggaggtagattgcagacaggcacaaattccttgcagctcctcttatcaagaaaaagagtgtttttctctacccctttaacgtagtgaaaatgaagttgtgtgagagtcaagcctggattgtaaggggtctttgagtttccttctgctcctctcactcttggaatgctgctgccatgtgaaaaaaaccggggttagtctgtgggaggatgagagactacatggagcagagacaagaatccccgaggaagccctcccatgccaatcagctggccgactgccagacatgtgagtgaggggccccagagctcccagccccaaccaagccaccagcaggctacagaaacccaccgagttggttcagattagaagagctaccctagccatccagccatcccagccaccccaaggaaccatgagataaatcaataaaatgcttgttgttttaagtctggagtgtttgttacacagcgaaagctaactgataacaaacccaatgatagcctcttttcaatgaaactacatttacaattcactttcaggaagtccttttttttttttttaatttagagacagagtcttactctgtcacccagattagagggcagtcactacagcctcaacctcttaggttcaaatgatcctcccacctcagcctcctgagtagctaggactacaggcaaatgccactaaacttggctaacttatttttattttcattttttaagagatgggggtcacagtatgttacccaggctgatcttgaactcctagcctcaagtgatcctcctgcctcggcctcccagactgttgggattacaggcgtaagccactgtgcccagcctctaggaagtcttgggtgaccaattctccacctagattgactgtctctccctacccacatgttgcctggtccatgtccctctcctcccagaagcagcttctgtttctgcctgtgatcctacaaatggagggataaatgtatgacctccagagtcacagaccatcgtccttctgcagcagcagcaagagagattggtacaggacccagagagctgctagttgcaggagtcctcctgtcccacctcttacttcacagactctagacccctgttactgggtatgccaactacactattattaaattattcaggattaaaaggaaaggtgcttatctggcactggctggaaggtgctaagcaacagggaaagaacatcctataaaaatgagagccctgatggccaggcgcagtggctcacgcctgtaatcccagcactttgggaggcccaggagggcagatcacttgaggtcagcagttcaagaccagcctcaccaacatggctaaaccccgtccctaccaaaaatacataaatcagccaggcgtggtggcagacgcctgtggtcccagctacttgggagactgaggcatgagaatagcttgaacccgggaggcaggggctgcagtgagctgagatcataccactgcactccagcctgggcaacagagcaagactctatctgcggggaaaaaagggcctgggagtgagtttcttgagtatcagatttccaagtattcattccccctcttctttttatccctcatttcccttttccttggcttccattaatattttctttcctgttccctcaaggtatccgtattcatttccagaaataaatgaagggtttcctggtttccattaaatttaatgcccatatcctctactcattccccttccttccaactttaggagtcttttcatttttctcttttacaactttccccacaactgccctcatataggagattctagaaatgccaggctcctgatgaatgccccaagattttcccaatcagaatcttaggaagttctgctactctattattatgaagagaccaaagacacatggacaaaggaacaaccgactttttttttttttagttttttatttctatatatttggggaacgggtggtatttggttacatgggcaagttctttagccgtgatttgtgagatttcagtgcacccatcactcaagcagtatacagtgaacccagtttctagtcctttatctcttacatccttcccaagctttccccctgagtccccaaagtccattgtatcattcttatgcctttgcatcctcagagcttagctctcacttatgaatgagaacaatgtttggttttccattcttgagttacttcacttagagtaataatctccaatcccatccaggttgctgtgaatgccattaattcattcctttttatggctgagtagtattccattttacatatatatatatgtgtgtatatatgtgtatatatatgtgtgtattatatatatatatagcacctcagtgcatatatatatatatatataacacctcagcgcatatatataatagcacctcagcgcatatatgcgtgtgtgtgtgtgtgtgtgtgtgtgtgtgtgtatataacagtttatctacttgttgattaatgggcatttgggctggttccacatttttgcaactgtgaattgtgctgctataaacacacatgtgcaagtatctttttcgtctggtgacttcttgggaacacctgattgtggagacaagggcggaatcggctggggatctggaaatcctggggcggagcagcagtcatgaggaggagccatgctgatgggaggagccatgctggtgggaggagccagctggagtcagctttgctgcagttttcttcttgccagggctagtttctatgctgcctaacttggtgctggatacagttctcagaattccatcacccttgaactctgaaatggtgggggtttttttgtttgttttttgtgaatgctaattttctacccaggactcttggaataagctgagatgcattgaccacgcagtttggagcaaagtggtttcacccgttcccatctacctgtcgggcatttggtacttttgagaaatgctttagaagaggaatgaggaaatctgtgtcatcgcctggaaattctggtccatgacctcaacagccctcctggaatttccctggccagttttctgtcctaaatgcagatcacctacattaatagaagattctgggcatttgtataaaaatggctgcagcgattcacaacgttttgtttggtgatagaggagagcagttcaggctctattctatagggacattaaggtatgctggtcaaagcataaagggtcctgaagggaaaagcaagcattcccaaggagaataaggaaaatgtaaacagctaccaggcgtgggtgccatctgatcgatttcatcttccagcaggaatttcccaaacctgatcactttctccattgctaacagagagtagaggaaacacagcaatggggaagtccgtttcgaaaacaaaccacttactctttacagcaaagggactgaagtttttcaggagaaagatctagctgctctcccattcatcaaaatgtggcagggcagtgattacaaatgcaaatgtaacctttaggtcctataggcaaagacaatgctcaccgcctgtatccagtgggcagttgcgactgggttcttttctcaattctagtatttttataaacctatcatcacatattctgcatttatttgtgggtgggtatggaatgttactgctacacattttaaataattagtattagttaatatttagtttctatttagtatagtttatattatttctatttagtattactttcgaaagcaaacttacatacaagataacatctatacttcccttttgagattcaagaactaaatgaagagctaggaggtgccaggcatgacgagaggtgttagcatctggaatttttacaatgctactgtgaaggagtaatattcatccacatgtctccattttgcagacgtgaagacagattccaagcacttaaggggcttggccatgattagttggtgatgtggtttggctgcgtccccacccaaatctcatcttgaattgtagctttcacaattcccacatgtcataggagggaactggtgggaggtaactgaatcctgggaatggagcttttctgtgctgttctcatgatagtgaataagtctcaaaagatgtcacggttttataagcgggagtttccttccttgcccatgctctcttgccttctgccacataagatagggctttcgccttccgccatgattgtgaggcctccctagccatgtggaactgtgagtccattaaacttctttttctttataaattatccagttttgcgtatgtctttatcagcagcatgaaaacataccaatacacttgggtactgcaaggcagaaaggagatgtgaacctagatatattgactccaatcccagtatacattcaggatacacttgtagtcaagtgcatggtgataaaaaagcacaagcatgacctgtggtttgattacactttcgtgacagcctcagggctgtggtgtcactgaagagggaaaaatatctatggcagatacgtttgcctgggattagcggaagggcagaaggagaagggggttctgatgcatctttctgctgcatcaagcacttcactgaattgccatctctcccttgggcctgtggaatacacatttcctttgtaacttcatcttgggtctggggcacagggtcttgggggtcatcttgtttacacaggaaacacaaggcttcaaaatggccacccccaactatgatggaacagctaggtttcagcggggagagtacttccgactcggtttgaagaagtggaatttgggcatatggagtcgtccctgatgatgactaaccaggctcagatctgtatttatacagcatcccagtcttacaaattgaacatgtaccaaatcatggggcatttttatacaaaagggacgagcctcaatgacatccggtggtggtttccttgctacaggatgccttttccctcttgaaccctgaccacctgccatgaaacctttgcattctgtgacccctctgcctgccaaagccctccatgggcagcttggtctagcctggggtagccttgagaggtgactgggctagaccttgaggggacgctgggctagaccagtttatcccagtagattctcaaagactcagcattgctgtttccattcatctttaagatgatacgcaaattttcattaagtgaacttcttcctcattttatttttctccccagagtttgatgtttaactaaaggagaagtaattcagggccccaggatgtgtatttattttttcaatttgtgatgtcccctcatcaccgcctctcagtgtatctgttggtaaaaatggaaagtgatattagtgctattattaacctccatcgttatacttggaagatttcagaagatttgatttacccagtatttccatctctgtatggctatggtgataagtgggaagtcaagaagaaacacaaagtaggatgtgaataaatccatttttttccacaataaatgactgaaatcatactcttcttccttttttttccctagactagggttttgtaagaagcatggtggtatgagttaaacttggcctcaattggttttgcttgagcacaattattcccatatggagtaggaaattctctgttctgcagagttctgggggagatgctttagaatgtggtgcactattcccctcaaactctatatgaatctgaagaacagaacagaatgctgagtgcattgcaggggagagacaagggtgtgtggttgcccagttacccagcgagagtcacgtcccagaccctacccacaggagactgacatttagacaaacttgttctcagccactggcgctgcgcccgacgcagggcatggctctgaatggctctggcatctgttttgtcttgcctcaagcccacacactgggacttgcttgttttcatccaatagcaattagcaccgtggtaaatgccttgtgctctgtgctaattcagaagaataagcctgtcgcaactccgccaagaattacagctaatcacagagggctcggggcgcacctgccctttcatcagccttttgttttaaaatgaggggttggtgcaacccgaaacactgcattctctccttggtcagggataaccatggagacccaggggagacttggagtgcatcctggtggccatccctgggacatgcttcctacaaaggggcacagcgagcaacagggaacccaagcagctatttactgtgggcaactgcagacagggtgggccccggggacactccacagaggtgcagaagcttggtctacagcagtgcccaccaatggagactgttcacaagtcactgcagatgcagtacttgggaataaagacctgggctgcctccactttcaagctaaaaagctctttggttattgttttcttttagcctcatcatctaacctagaacctgggcttattctaagaatataccttctgtcctaatttggtattgatcatttattgatttttgtgctttttccttttaaagttaggtttgaaaaataacttacattcaggaaaattctcccctttaaagtgtatggatctatgagttttgacaaatgtcaacaggcacatcaccaccaccaccaccagggagccattggatggttcttttgtccctgaacattctttcttgtttgtttctcgtcagttacccttccctgcctccagcccaggaatctactgatctaatttttattcctattattctgctttttccacaatgccatataaatggaataattcagtattttttgttagcgacttctttcacttagtatgatgcctttgagatccatctatgttcccttgtgtatcagcagtttgttgttttattgttaagtggtatttcatggcacggatgtactgtagtttattttccagcaaatggacatctgggctgtttccaacttttagttattattaataaccttccacgaatattcatgtacatctttgtttgggtatatgtttttatttcttttgggtagatacctaggagggggattgcttggtccttcatcatatatttaactttacaagaaacttcccatatatttttcttttttgcttttctttatttttttttttgagacggagtctcactctgtcacccaggctggagtgcggtggcgtgatcttggctcactgcaacctctgccccctgagttcaagcgattctcctgcctcagtctccggagtagctggaataagaggtgtgcgccaccatgcctggctaattttttatttgtagtagagatggagtttcaccatgttggccagggtggtctcgaactcctgagctcaggtgatccactcacctcgggcttccaaagtgctgggattacaggtacgagccaccatgtccggcctgcccatatatttttcaacttgcattgctatcagcaacatatgcaaactaaaattgttcatccttgtcaacacttggtattggaagttttgaaaagtttagtcattctaataaggatctagaagtatctagttgtgattttagattgcattttcctaaggactaatgatactgagattcttttcaagttataatttatttaaaaaatcactttaaatctactctgctcaaattcatgttgaagacaggtctcatgcaacttattttagtgggaatttgtcaaatctctcccacgtgcttagaaacatgcagcccaggaagaggaaaacatagccacgaccactgatgtgcgtggagaacaggaactgctttatttaacttttcttccatgctgagctcatctcaggggaggaaccgagcctctccatcgcccacagcacccagcccagggtcaaacacaacagcaggtgcttcaataaatatttgatgattgactgaagcaagatggtggctcttgttcccagtggacatgactagggtttgtgcctgtctagtgggaggtgttagaacctagagagggctgattgaccacttactaaaagatctgcccagtggaaggcattcatggtatatggaggtcagcggtcccctatcaggctgctcattagaaccagggaaagagtttaaaaacatatggatgccctggaccagaggcggatttaccttgacactaatgagattcaagcttcaaggcctcaattgcatggtacccactgcgtgctgggaggtcctcggagttctagagtgttctaggtatggaggggaagaagccaggttgcaattagaacactcgaaaagatctctaaaccaagggatctgactaggtaatgtgtaacatttcttccctcattttaaagcaatactaagcatggaattttttaaattggtgatttcgttttgttctgtttttcattaagaagttctcacaaaacctggatctgcccctgctggatgtcaccccagaggttgtgatttaatttgtctggggtgtggcccaggccctggcaatttttagagcttggcgttgagtggaatatgccccagggttgagccacatggttacagtgtccactaatgaccaggtgtaggctacaagccaccgggaaagagcccagtcatgtgtgagcccttgtcattttaaacatcaactcttcaaccaaatgggccctttttgttttcttctaagtcagtcttcttgttttgagaccctccgatttcagtgtgtcccataggccatctccctgtggcacccactggcaggtcacaccccctgctcactcctccccagtggcttttcccgagccactggtgaaagcccaggctgctccggaggggcagcacagcaagctgtcaagagcttggggcagatgcttgagtccacactgcagccccgcttctgagtcagagggaactggatcagaatcccacctcggccactgaccagctttgtgcccctggacatgttccttaacctccctgtccctcagtttcttcacctgtaaaatggggatgataataggaacagctgtatagctttcaaatgaagatgaaacgagaggatggttaagtttctgctgcaggccaggagcatggcaggtgcctgacaaaggaggaattatgtcctggctgattgacacctacccgtcttctggtccaccctatgccatgcttcctgccctccaccgaactgccttccttctctgacaatgttttgtcttcactggccacattgctgatggggcattgtctcatcacctgcttctcttctcagttagatgctgggttcttagaggggagagacaaggttttacacccttctttccacagtggttgttccaaggcaacaatgtcatcatccacaaaataataatagctaacattttttgaatgtctgtttttcagacaagcaacccatacctcagggaggctgtataaccatctaagttcacacagcctatgggataacattcatccatgtcgaagttttcatccgtctgaagcaaaaatgagaaaagagcaggtagagctaaccgtatttatttaaaggactagcttttatttggagattatattactccctttttaaaaaattttaagtgctctttcactgacggcatgtgatagtgacagtaggttgcagatttttttaaatgactttacattgcaaaataaattattgagtattctatatttttctctcccagtttttttctggtaaaatgttattggtctttgaagtaaaaaaatctgagacctgttagtctgaaaaacagctgtatataaaatgatgctcaatctgtattggttaagtcaatacatatgacattttacattaactcctgacgcaaacttgttgccaatagaaggaaggaagagaaaatctttcagttcctaattcaatttctttccaccaatatttactgagcacctaacttgtaccaaggactgtgctagagtctatggacacaaaacaaataaaacacaaccgctgccctcaaagaacctagcgttattcccaacagtgaggttggagaaagtaaaaaggaacattgctgctagaataaccaatcaatatttcaacagaaatatcaatattgtaaaaatattcaatcaatatcaacatttgttaagggtatctttaatgcaatgttgttttttgagacagagtgttactctgtcgcccaggctggagcacagtggcgatgacatggttcactgcagccttaacctcctgggtttaagcaatcctcctgccttggcctcctacatagctgggactacaggcaggtgccatcacacctggctaatttttaaattttttgtagagatgggatctccctatgtttcctgggctggtcttgaactactgggctcaagtgatcctccagcctcagtctctcaaagtgctgagataacatgtgtgagccaccgtgcccagccaagggtgtcttttggcccttaaagaaaaataccactagacagggcacaatgcttctatttctccaccagtctttcagcccctaacgaggctaaactgataagggtgttctaatcctcatgtggtaacattcttggggttcacctgctacaaggaggaagtgcagatagcaataagacttctaacaaaaaagcatagatataagggctatggatcatttgaaaaacatttatgaaaatataaagaatattaaaatataaagaatgaaccaaaaacctacaatcaaaataactcctgttggatatgaaaataaaaagcatttcctcatgtggctagaaaattcaacttaaaaataggatggcataaaatgagttctgactccgctcagtaggccagctccatgtatctgttcagatgtattttccatgcatataccatcaaaatttatatataaaacacatataatacaatatacataatctgtccattttttcttttctttacgcaaaggactcatactgaaccacactcttctccacttctttttacttgaaaataaatcccagagatgtttccgcatcagttttttaagatctagccccctctttgtaaaggctatagagtattctatcagaggatattccatactttttttttaaagccaatctcccacttgccagatatttaatgtcttttgttacaaataatgccttaaggagtgtctctgtataggtatttcagtgtacttttaaggtatatctgcaaatttctacaggtggaatgctgcttagaagaatgtatgtatttaaatttgtaggccggatgcggtggctcacgcctgtaatcccagcactttgggaggccgaggcgggtggatcacccgaggtcaggagtttgagaccagcctggccaacatggtaaaaccccatctctactaaaaatacaaaaaattagctaggcatggtggtgcgcgcctgtaatcccagctactcgggaggctgaggcaggagaatcacttgaacccaggaggtggacgttgcagtgagctgagatcacaccactgcactccagcctgggtaactgagtgaaactctgtctcaggaaaaaaaaagtgtaatagttattaccaaattgccttgcaaaaaggtgcacaaatttgtattcctgtgaagaacggtggtgtaattctttgccagggatttgtgttctcaaacttttgcattttttccaatttgttagttgacttttgatatgacatctatgttttgcattgcttattttcatatttgtttggtcagcatttctttattggtttgtatacagtcaaacttactaatcttttcctttgtggcttctggtctttatctttgttttagaaagtgtgccctcttcagtatgctgagttcacttatgttctattctataactttcatgcttttgttactttaaagtctttgatccatttggaatttatttgggtttattgatgtcactttatttttcctcaaatgtttagccaggtgttccacactatttattaagtaattcatctattctttcctgacctgataccctatttttatgtttaagtctatgtctggattccacccatctgtttagttctttagcaataccaaattgctttaattattgttgcttcttaatctgttttgataatctaataggcacaacttactccattagacttccctacctcctccctgaagattccttgctattttgtatttatgccacagtaattaccagtattattttctgaactttctctaccaaaaggaaatgcctcttggaatgctataaatattctatatgacatctggtgtatatttcggatagataccctttattggtctaagaaactgtagttccctataaagctatgtccacaggcagtaagcaagcaagacttttgtctgtaatttttttttctgttttaaaacttgctttagcctctggattcaagcacagagatgtacagagcctgctaatttcccaccttttatgaagcacatttagtctatatcactgtgcagtagcccgattccaggttgccatttcctgtttcgggacagagagtctagaggtccctggctttagtctcacttgttactttgtatttgtgttccatttctggcccatagggaaatctatgacgcttttgagtccagttacatatttacctttctcttcctctattttacatgttagaacagagggggtgagtcaatgtgtgaatttaccatgccctcctgataggaaatctgtgtgtctgtatttccctcttaggttttcaaaaggagattctcagaatctagaagcatcacttgacgaagcttcgggtggtcatgactgctggggctcaggggacaagatcacatggtcgtctttcactagggggtcttttggaggtttgtttttacatctagaaactccaatatgttaaaatccccatgcataatcaagacttccactatatacctcagagatattctgagttcgattccagactgcctcaataaagtgagtagcacaataaagtgagtcacacaatctttttggttttccactgcatagaaaggttaatgtttatactgtcgtctattgagtgtgccatagcattatgttttaaagcccaatttaaaatactttattgctaacaaatgctgatgctgaatcatgaagggagcacatgctcttggaaaaactgtgcaaatacacttgcttgatgcagggttgccacaaatcttcaatttgtaaaaaatgcatatctgtgaagtgcagtaaagtgaagcacaataaaagaaggtatcctggtatatatttttgcttagccttacagtgagacttttgagctttattctatggaccgtatcctttgctccacacctaactcgaaagttaggggcggtcaagagtgatggggggggacagggaaggatgatattgggaacttattagaagatgaagcgtccatgccccatttttaaaactcttatcatttttcctacacaacaaattgtgtaatatgaattctctgatctagttggttgtgctgtttgtttagaaaactgggcattggaggggctgtatttcttttcttcctttttctttcttttttttttttttttcttttctgagacagagtttcgctcttgttacccaggctggagtgcaatggtgcgatctcagctcactgcaacctccacctcccgggttcaagcgattctcttgcctcagcctcccgagtagctgggattacaggtgcacatcaccagactggctaatttttggtatttttagtagagacggggtttcaccattttgcccaggctggttttgaacacttggcctcaagtgatctgcctgccttggcctctcaaagtgctgggatttacaggtgtgagccactgtgcccagccccagtggctgtatttcttacagtattgttacttacatggtacaggtttacataatattgaaaacaataaaatgtaaaaaaattatactcttccatttctttggttcttttaaaaatatttcctttttttagtgtatgtatttaaagtgtacaaaacgatgttttcctatatagagtgaaatggtgttttgagatcttaaatgtgaaatcttgtcatatttctgctgtggttattttcttattttttcaaaagtagaaatgctttcatattctcacaagggaaccacttaagacaaatgtcaaattttccatgaatgtgggaaatagtcgattacatgaggggaaaggatgtttgcggatgaggcaaacattccatcatatgggctaagtcaaactgtgacgtccttaaaactatcctctgccatgttcctttctaccttccaaggtttaggaggaatttctccccattagaacaggtcagacatggacaaaatgccatgttttctaaaggagatattctacagaaactgagaaactggttaatttacataatgcatttttgggtatcctgagttattttcattaaacgtactggcaagatccttaagaggagtgattctgcctcacactttaaaaaatgttctccaaaggacttgctatgggcttggcaaacacttgctgagttgacttacaaaacacggttggcatgatctcagcattttaatcatgacaaatctcagggctgacaaactgcatgttgatgtccttgttttctatcgaatgaaaatatttaattttcagaatgaactgaaagtcaccccgggtttacttaataccaaccttgcctcagatgacaaatcattctcaagggcagcactgtgtctccagaggcccagagcagggccaggctccctggattttagctctaggtgtcctcccatttttctttcttactgggtagatgaaatctttattaaaatccgaaagcatgatagtatttatcctcaggggctaccatttatagaggagaacaactccccaaattgtcgatgaattaaatcctcatgactttgtccgctttgtagatgtctcccaatgcaagcatttctgtctgtaggtcaccaatgtacctaataaagctggggaattcatcgctgaatattttctgattcactcatctttgaattcatctgctttgcttatggtggaaagagaaatgtctctgcatgagtccattctcgcattgctataatactcgggactgagtaatttttaaagaaaagaggtttagttggctcacggttctgcaggctgtacaggaaatatagtggttttggcttctgtggaggcctcaagaagcttccaatcatggtggaaggcaaagtgggagcaaggtgtcttacaaggcaggagcaagagagagaggcaggggagatgctacatacctttaaacaacaggatctcatgagaattcacttaatacctcaatgatattagcaaggggaatatctgccctcatgatccagtcacctcccaccaggccccacctccaacactggggattacaatttgacatgaaattcagtgaggacacagatctaaaccataccagtctatttaaatgtttgtgtccaaaagggaacatttttgggtacttttatcttttccattaatttggtaaatgatcatttaaacccaaggaagaagtttctcaaactaaataattatactgatattctcctaagttaaaataaagtttttgttactgttgttgtagcaaatctcttgttaatcaattttatcattagagtctcagacagtcaaaagtgtgagttaatcccagcgtgcatgtttttggtaaagtgtaacgatggaggaagaaagttgtggttgcttgcttgcttgtaatgtgtctggagttggttccttccactgggttcgtggtctcgctgacttcaagaatgaagccagggaccatcaaggtgagtgtcaacagctctaaagatggcacagacccaaagagtgagcagtagcaaggtttattgtgaagagcaaaagaacaaagcttccacactgtgtaaggggacctgagcgagtaggaggtgctggctggggtggccagcttttattcccttatctgtccccacccacgttccgtttttgtcctatcagagtgctcttttttcagtcctccctgctattggttacttttgggatcttgctgattggtgcgttttacagagcactgattggtgcattttacagggcactgataggtgcgttttacagagtgctgattggtgcattttacaatcctcttgctacagagcgctgattggtgcattttacaatccccttgctagctacagagtgctgattggtgcattttacaatcctcttgtaagacagaaaagttctccaagtcccctctcgacccaggaagtccagctggcttcacctctcagcaggagtgcttcaaaaaattttcacctgtcttctgttttttctactactaagtggggggcatccccatacttctcagttaaatgtaatacaacttcctttataatcttaaacttccggtctatgcattctttttgtaatctttacaaattacaatgctaatcatcttagggattttttttttctcaccttacagttaattcattttgcacaaattttaagctaggacagaagttttgacccaaggatcccatcaaaggtattggtttttccctccaaggagttttcagaaaactgagtcccagatagcaatcagatttttgttatcaaacatcccaaagactacgatatctgtcgtaagtaaaatacccataaattattgggtattttatcctactaggggtcagaagtatacagtgtatttacgttttatcatatattagggatctgaaagtgacatactattttatggctataaagaaaaaaagaatgagctcatattcaagggaacattgcattttttatattgagaaaataattttaagacaaaggtaatgaggaacccaatggaaattgctagtagactctctaaggtgtcaagtactgagtgattcttttgtctgtacatttctcatgtcttacatggcattgtaaaggcaatccggtcttttcgttcatgtggttttggatcttttcaacaatggcattattctttgtacttagaagcttggcaggcactagaacccatctttcaagcagaacaggctgaagacatgaggacatacagctgcagcttgaaggacgttgcacagaatattaaccctgcttctctcagaacagagtcttgcaactgagcaaatgaagcaatcagtagctccacaaataagacactgcaacaaattaaaaagtacctaagatgctcttgtagtctgtgataacaactatgcacgacagaaaggtttgtgaaaaacagatacatagactaatggagcagaatagagagcccagaaataaactcatgtatagatggtcaactaaattttaacaagagtaccaagaatacacaataggaaaatgacagtctcttcaataaatgatgttgggggaactggacacacacatgcaaaagaatgaaattggacccctgttggacaccatactaaaaaaatcaactcaaaatggattaaagacttaaatgtaagacctgacaccataacactcttagaagagaacataggggaaaagatccttgatattggatgtaacaccaaaaataccggcaacaaaagcaaaaataaacaagtgggactctatcaaactaaaatgcttctgcacagtaaaggaaacaatcaataaaatgaaaaggtaacctatagaatgggagaaaatatttgcaagccatatatctgataagagtttaatatccaaaatacattaaaaactcatacaactgaatagcaaaaaaatgcacaaatgacctgattgaaaaatgggcaaaggaactaagttgacatttctccaaagaagacatacaaataaccaatagacacaggaaaaggtgtttaccatcattaatcatcagggaaatgcaaatcaaaagcacaatgagatgtcatctcatgctagttagtatgactcatattttaaaaaaaaggcaagtgttggtgatgatgtggaaagaaggaaaaccttgtatattactggtgggactgtaaattggtacagccattatagaaaatagcatagaggtggccaggcatggtggctcacaaagttctgtatcccagaactttgggaggccgaggcaggcggattacctgaggttgggagttcaagaccaacttgaccaacatggagaaaccccatctctactaaaaatacaaaaaatgatagttaggcatggtggtgcatgcctgtcatcccagctacttgggaggctgaggcaggagaatcttttgaacctgggaggtagaggttgtggtgagccaagattgcgccattgcactccagcctgggcaacaagactgaaactccattaaaagaaagaaagagggaaatgaagggaaaggagaggagaggagaggggaggggaggggaggggaggggaggggaggagatagtataaaagtttctccaaaaagtaaacatacaactgccatgtggtccagcaatcccactactgaatatatattcataggaattgaaatcagtatgatggaaagatatctgcactctcatgttcattgcagcattctcaatagccaagatatgaaaacaatcataaatgtcaattgatagatgaatggatgaagaaatggtggtgtatatacacaatggaatattattcagccctaaaaaagagggaaaccctgccatttgtgacaccatggatgaacccagaggacactatgttaagtgaaataagcctgacacagatagacaaatattgtatgatattacttatatgtgaaaagcatagaagcagagagtagcatggtggttgcaggggctgggggaaggggaagactgggaagtgatggttacagggtacagagttgcagcctagtgcctatagctaaggctgtagctaacaatactgtgcctgtgcctatagctaacaatactgtattgtgtacttaaaattgctaagagggtacatcttacgttaagtgatcttaacaaaacaaacaacagtcataataaagggcatgggaggaaactttgagaggtgacagatatgtttataactttgatggtggtgagggtttcatggatgtttatttatccacaaactgatcaaaaggtatatattaaatatgcatagctttttatatgtcaatcatacctcaattaagcggtttaagaaaaacgaacaaacaaaaggcttgtgaaacacactaatcagagaatataaatatgatcaggggttacaggggcagcatacctgattactcggcctgttttggggccagacatggagataccaagtttagggacaaccaaatgagaattcattaagactcacagcacaaagctacctcaaaggaatccaaaacgccaaaatgacacataacatgaaaaaaactaattgcaattctaaagaaaactgaagtccgcgaattgtgtgtgcgcgtttgtgtgcatcttttatttttccagatatttgtttgcaaagttaacacagttttccctttgtatttttcccccactccacaggtgcatttcttgttcccagtcctaagtagcgtttacccccttttccatcagtaagcaatggttcggcaaagccaagaggttatctgatcttcatcctggaaggatggtgatcctttgctggtgacttgcattttctgcctagaaatctaaacaatttttctttgttttcaaggttaaaaattttaaccagaatatagcttaaggttagtatttctctacaagtctattattaacttgctttttatctgtaattctgttatctctttgttttagggaattcttttggctattctatctttgatggatttttcattggtgggttctctacttcaggaacatcaattgtctttatattgatcactttttgactgtcttccatattgattacattgtctcttgttgctttgtcttttgttttctgcactcactacgattaaattaagccttttctttatatcagaattttaatttagctaattgtatttcagtctttgctattctaatttatctatcagttcaatggtagtgttgttttagccctcagtttcttctttaactttgcagtctttcttttcttcttgtttcattgtttcataatgtttgatttcctttaaaatatgtatgttatttcattaacaacatgatgcggttgcataaaattgtcttcctttccttggcttatgttttcttccagattaagtccttcatttgtcatttttgtgttcaattttattcattcaatattgagttattgagcatctattatgtgtcaggcactattcttaatgttagggaaaagcctgttagggaaaccacattcctgccctcatggatatcacatctcagacagagaagtcaaacaacaaataaataaatctatactaaaacatcaagctggtcagtattttgggtttgtgaactcctggctaactgctcaactctcaacttctccattgccagtgccacgtaaaagcagccacagacaataggtaaactaatgagcgttgctgtgttccaagaaaactttgctgacacctgctttccggcaactgtttacatttaccgatgttattctcatcctcgttttggtattgctttctgaggtcattgcgcttactgatgttatgacaatgaggtataaagtccagtaaagagaaaaaaggatgatgaccatccccagggacacgtgttgagccctttccttcacttaacaattatttcaagaccaaggggaaagggtcattttggcctctcctggccatgatccatttctggttgtctgtatataagaacgtgaaggttggaatctgatactggcttcatcctgcaactctccaggcccgctactggggggactatcaactaatgggggacccagataataagaaaacatggacatccaccaatgaaagttccctaatggagtaagaggtcacaggcatgttgtaatgacacctgctgacttagtactgctcctactgcctgatttcttttacgaacatggtagacttaaacatttaagtgtcagcttatttttctaggccacgaaaatactttaaaaatacattttaaaattcttattaccagcctgggcaacatagtgagacattatctctactaaaagtgaaagaagaaaattagccaggcctggtggtgcatggttgtcatcccagctactccaggggcagaggcaggaggctcacttgagcccaggagttcgaattcgcaatgagatatgatcgtaccactgcactccagcctgggaaacagagtgagaccctgtctcaaaaaagccctcttattttaaaaaacagtttttattcactgcagaaacaaatgcggataggcaaagagaagaaaataaatatgatcctggccaggcgcggtggctcacgcctgtaaccccagcactttggggggccgaggcgggtggatcatgaggtcaagagttcaagaccagcctggacaagatggtgaaaccccacctctactaaaaatacaaaaattagctgggcacgggggcaggcgcctgtgatcccagctacacaggaggctaaggcgggagaactgcttgaactcggagggcagaggttgcagtgagatgagattgtgccactgcactccagcctgggcaacagagtgagactctgtctcaaaaaaaaaaaaaaaaaaaaaaagaaggaaaataaatatgatcctgaatccactatcctaagatgactaacgctaacatttctagatatattcttcaaaatataaatctataaaaatattaatatatgtgaaatgtattattataaactaaaacactaaaattaaaatggactcatattgaatatgtagcactttgcagccatcagtaagtaatagatgagagcaataacatatgtcaccgagtatgaaatactctcaaattggcctgctttataaactgctttttgctcttacgagaatatcatgaaaacttttataagtctctgttttttttgttttgttttgcttttgttttttgcaatggtcacatagtattccactgcacagatgtaccatgacttattcaaagagtctccccttgtttgggagtttactttgcttctattttttcaatattatgaccaacactgaaatgaatatcccttcacctaaataggcatatattcttttttttcccagggtgctttgtttttgttttgtttttaagacacggtctctccctgttgctcaggctggagagcactggtgtgatcagctcactgtaacctttaactcctgtgctcaatggatcctcctgtctcagcctcccaagtagctgagtctacaggcctgcaccagcacgcctggctaatgcttttataaaattttcttttttgtagagaaggagtctccctttgttgcccaggctagcagtttgcactgtgtaaaagaattcttctttacaaacatgctttacctcatttgggagctggcctcattctgtgttgaaaacttggttgcaacccttgagaaagggtggttctctttgctagttttggttgggtgggaggagaggtagacaaccctggattaggattaggatatcgatgctctgtgaggcagtgcccacaaggcgatgaggtccacataacaactcgaagagattaagggatcggtagagggtaattgtgtgagtcagaaatcccattgggaccattactacctaacaccaggagagcaccattaaaccattaaatgctaaaagtggcatgaaaaaaatccaaagggtgtcgtcagctgacaaagggcacaaaattcatactctgggttgacatttagcccttaacacaccatgacagcatgaggctctgtggggtgtgtcaggacgggggatctgaccaaactctcccctctcttgccatctgtggctctgcctcatgtactaatattacagaaacctctgcgtaaagaccatgaaatgcatattttttgacatatgaagcctcggctggtcatgtccgtcagggaaatatatcccaagatgggcggagctttcacatcttactcatatttacactttttatttaagccccctgttatttctctgagagtctaggatacagcaggctctggggaaataagtattgtaaagttggcaggtagaaggggtttttggctgttgtttttcaaacatattacacatatttttacattattaaaaacacacgcttccgcacaacaccatttccccagaagcctctctggctgactagtgtcaagcctggtgatttataagattgtttgcatatattatattttaaaacacatattgcttttgtaaaacgcgtatttattatacattttggaattcataatatgcgcagaaaagcagcctccgcctggctggatctgagacagtctgtcacgtaaacacatttctggaagggacttcatacaaatgctttagacggggccaaccaattcttccctccgcggctcccatggtctctccctccctctctctctctgtctctctctctcacacacacatgcccctctccccctcctcctgcacgtcacacccatacaaataaataataaaaacagtaatggaacaacggccccagaggaaagctctgttaggaataaacctgattttcaaagctgcacaaaaatcatcaagcaaagtaaccttgtgaaaagcaacaattcagaaccctatagattgggcggccccaaattagggaaatggctctgtgaaccccagtcaagtacgttcttcaaatacctcaagctgtgaccttaagtacaagacttgatttgaaatcaaattgtgtggttggtgtacgggaagagtgttccagaccccggtctccttggtaaggctgtgtgggtcggtgtgtggctgtgtgggtgtgtgcgttggtgtgtggctgtgtgggtctctgcgtagctgtgtgggtctctgcgtagctgtgtgggtgtgtgggtctgtgtgtagctgtgtgggtgtataggtttgtgtgtggctgtgtggatgtgtgggttggtgtgtgagtgtgagtgtgtgggtgtgtgggttcatgtgtggctgtgtggctgtgtgggttggtgtgtggctaagtgggttggtgtgtggctgtgtgggtcagtttgtggctgtgtgggttggtgtgtggctgtgtgggtcggtgtgtggctggtgagtcggtgtgtgggtgtgtggttgtgtgggtgtgtgggttggtgtgtggctgtgtaggtgtgtgggttggtatgtgtggctgtgtgggttggtgtgtggctatgtgggccagtgtgtggctgtgtgagtgtgggtcagcgtgtgggtgtgtgggtcagtgtgtggctatgtgggtttgtatgtggctgtgtgagtgtgtgggttgctgtgtggctgtacgggccagtgtgtggctgtgtgggtgtgtgggtaagtgtgtggctgtgtgagtgtgggtcagcgtgtcggtgtgttggttggtgtgtggctgtgtgagtgtgtgggttgctgtgtgggccagtgtgtgggtgtgtggtcagtgtatggctgtgtgggttggtgagtggctgtgtgggtcagtgtatgggtgtgtgggtgtgtaggccagtgtgtgggtgtgtgggtcagtgtgtggctgtgtggggtggtgtgtgggtgtgtgggccagtgtgtgggtggtgggtgtgtggctgtgtgggtcggtgggtgggtgtgtgggccagtgtgtgggtggtgggtgtgtggctgtgtggggtggtgtgtgggtgtgtgggccagtgtgtgggtggtgggtgtgtggctgtgtgggtcggtgtgtggctgtgtgggttgatgagtggctatgtggggtgatgtgtgcatgtgtggctgtgtgggtgtgtgggtcagtgtgtggctgtgtgggtcggtgtgtggctgtatgggttggtgagtggctgtgtgggtgtgtgggtcagtgtgtggctgtgtggattggtgtgtggctgtgtgggttggtgagtggctatgtgggttgatgtgtgcgtgtgtggctgtgtggctgtgtgggtcagtgtgtggctgtgtgggtcggtgtgtggctgtgtgggttggtgagtggctgtgtgggtgtgtgggtaagtgtgtgggtgtgtgggtcagtgtgtggctgtgtgggtcagtgtatggctgtgtgggttggtgagtggctgtgtgggtcagtgtgtggatgtgtgggttggtgtacggctgtgtgggtgtgagccggcagcaggctcatgaaaatccaggaaaacaaacatccccattcaggaggagccctcctccaagccttcttgctgtcccctccgttcctccctctcacaggatagagagcgtccccagcatctgggccggcggagatggactgcctgtgcccccattaatgctctgaccctgcacatttgctcttagccgttccatctcagcagggagccaaggaggagggtgggggtctggctctttatcagcctctcttgcctgtcaccccatggagggagggagggagggagagaagggggactttgggggctggggtggagaggtgggaaggagatggaaaaggagatgaaagcagccagaattatttctcaaataaaaatccggccaggggattgcaggctcccagtcccagacagaagctggacatccctccatgtggttctgtttctcgatcctgtcctattagcgtaaaaaggaaaaaggaaggccaggtgctgagacctccttgctgatgggcacttacaaaatggaagggacgagattgcacagacctgcccctgcactgatagctgaagacgcttttcttcacctacagaaaatgagaaccagcttggaaaaacaaaaaggccgtgcgtctaggctctgtgacttggtccagatgtgccaacttagcaactccccacgctgtccgcagcggagatggatttctttaacgttcctgttatcaagccctcctatttgtcgcccccaaactcagtttcccccagatgtcttggactgcttcgtttgaggcttctgcagcagctgctgccgctctacacaaaaggcggctccgagagccaagattatgtcttcagtgcattacgggcacatgcagtgcgtatatcttcggtaaataaccgcccgttttcacatggattatttagaatttctgatgaaactgcagaaatgtcaatgcggggtctaagccaccaatcggagagcggctccgcgacccctctcttcttcagcaagactgctattatcttcaaggggaaaaaaaaccctctttgtctcttgttataccttttttatgatctaggatgctgttaataacgactttgtgttacataaaacagataaattaatgtcaccaagtccccaaagtactgaatcaaccctactccttcaaaggaaagcagaaagtgtatgaactgaaggccaggactgaagaggggctcctctcctaaaatgggagaggtcctccaatcgctggcctgttcctatttgaaatgcaatatttaaaaaccgtgtggctggggaggaaaatgccgctgtctggctgaacatccctccaaaggggaaatcgagcgtgtggttttagttggtgatttaaagctcctgtaactcattatatgtgtgtgttcctgctccagccattcagagcaagggcagggtggggggaggtaggtggttccctcattagcaattactctacccttttggtggggatgtaagagggtgactcaaaacagcatcttcagggaagcccagctgtgtgttttcaaggtggggaaaaaacctggctttgcacgccatgtgaagagccccagatatgtatctctaacaggaggggacggggcacatgaaacatttctcagcagctcagaggtactgctctctaatccacagctgaggtcctaggctggcaatccaagccatgtccccagggcaccttgagtgccatccccaagcaggagctgcatcatcctttcctagtacacccgctctgcaaagccagtgtggctggtctcggtcctactggtcagtggtggctaaagagacaaaacaaccacccatttaccattctggtgagcccccaggggagcaggagaccctaccaggtgcaccgaaatgtggctacaaaccaggaatccaggagggagtgtgagagaaaggggatctgcagaaagccttgttgggtgggatgtccacaccaggccccctgtgtcaagtcacccggggcccctttgggatgcccccttcaggggtgctgaggaaaggtggtttctgagcctcaattccaatatgaagattataatgtggaagtgataggtattaattagagagaaataaccacacacacacacacacacacacacacacacacacatatagacatttatatacgaactaagaacataagctcatttctgtaaatcacaaggtttcaaacagtattcattgagtgctcgccatattccccagtgctaggcacaggggaatcaggaaggagtccaaatagactctgtgccttccctgatggagattatagcttcgtgaattccctaactgacagcccctaaccaaacgatgggaagtgagtataaaactgcagtgttcagcaccatgagaacctgagagagagactggaagctcatctgggaggtcaggaaagccccctcgaaaaaaacacactaaagctgagatggaaaagatgagttggcatgaagcaggtgaaaaggtgttctaggaagagggaagagcctgtgcaaaggccctggggtgggcaggggcctgtttaatgcaacagaaggaggatgccatggggtcctcagctaaaaatgttccaagcctgaagcctaacttgtaggtttcagcctagtaggtttccagaaggaatagaggtggacagggaagagaggtggaaaaggaccccaactgggtgtgggctcagagtgtgggactaatggtgagatgggtttcttctactatgctacatgtcacaaagctgcttgtctttcactgggagcctgctctcttccctggtgctttttgggtttcagtgtagatagaggaggaaagagccactaaggtgcttcgcagagccagcagcctctcaggctatttctcaagttcccagatagcttgggggcttagctgtgttgggagtagaattaaggaaccttggttagtgggataaattcctattcagagcaaagccatgaggatcttttgggagcaaatgggaaatgcagaacatagagaactagaaaacatggccttgggaaaaaacatcatgagaaccttctgaccagggctggtgatatctgcagcagatcaggagggcttagaagatgtaaaaccattagaaacacattctagccaatcaagttgacctcgcctgccacaacaaacccaatccaactaaaccccacagcacagaagtgcagtttgtgaagctgatgaccaagtgctctcagtgtctgtagagttatcccattctccttccaacggtacccatggtttaggcttcctgacaatcaaaccccacaccagctctgtatatgttcacctagacacgggccttccccatcttcatccccactgatgtctctggctgcctagggtacagctgggcccatggccatcatcaaagggaaggcaggggtgaggaattcggggagctgccagtgaaaaaaagctctcggagtttccaggttcttgaacattttctctggaatgaaggtttattggctccttgctggttatgagattatacgccagtcctccagagatacgtgtgaaggatcatgtaaatcccacattctggcagaaagagacaaacactaatttttacattaatgacatctcaacatggagttgctcaggagagcatctgctcacccctgattagaaagcctgaagtgtgaacagcatctgttctctcgcctctccctctctgtaatggacagccaccagaagaggtcttagcacctggtaagcaggtgtattgcccctgaaggaataggcaggtacctttaactatatgcattacctagaacctgtcatgagccatatggccatttctagaaggctggataggcttttgagaagatgcttttgatcattctacatgagagatctatataaactgccaaggttaatagggcctggcttgggggctgtctctgagtatgccacatattctgggaagaacttctgggtgctagtcacttggcaagcatctcacttttgtctttgtttgataatgttttatttacatttgtagaaatggtctggatagagctctctgtacctctcctctgggtaagcagagggcatgcctggaactgaagtttctaagtattgatattagtgaggttctgagatgccatgtaagaccatgttcaagttcattatgttacttatcttatagatagttgtatagattggggaggaaaccctaaaagcaaaaataaaacaaatcaaagggaaacactgcccatgttagaagacagaaggaaatttattattaacaagagaaagaagtggaatcagggcaggttaatgaccttggctgtgattagtgtcctttaccgagcacagcacagggtgtgacatgtgggtatagatatttctccagggtgatggctaggatgtctcaggcctgaagtaaaggcattcagagcctgcaaaggagttctgacattccctactccagggtgatggcccatggcagcattctgtggctttaacttccagcccaaatctagaaccccttgacattgtgagttattttatagaaatgccaggttttattttagtagaacacttctaggaggctaaaatgaaaactcaaaatatgtaaattctggaggtaacagaacaatcacctgaaaaaggatcttttatgtccatcagctcctttcaaatcttaaggtaaaacattttcctgaagcttctaagagaaattgcccagctcttcccttggtgcgaatgcttcctactgtgtgatgtgtgtgtgtgtggcgggagcgggcctcagggggtgcataagaaggggatggggttcttgatgggtcaccagggagagcctgaggccatggtgaggggtggcctcttgagcccaggtaggcttgattccaagacacatcagtcatctttgttctgttcatggactaaagctaggaggtattcctcgggctggaagcagaaactttctggtatgttccataggggacctacattttgaagaaggtagacagtctgctgacagttttggaagaagccaagtcaacacatctgggattcagagatggcatctaccatggaggcaagtggcctccagagagagcttgtcctaactgccttgaaacaaaagggaagagacactgtgcttgtctaaaggtagaaccaccttcaaacccggctgcgatgtgtgttttagaccaacctaccagaagaggaacacaggtttgcgtgaggagatggggatggggacaagaatcacatcagaggcagctgtgagaaaccactgcaagattagaatttttgagagagaatacctgggcaataccagagtcacagctggtaaaagtttgggaaagaggctatgaaggagactctgaaccccgctagaccaggaaataactccacaaagcccttcatgaagcacccaacaccaagagggtaaagactgactgatttgcaggaggagaactaggagtttccattgaaatttctaggaaggggattacaaatttaaatgaaagccaggaatcatcataaatggtactttcaagattttggtgcctgtaatgtccctgtagtttaattaactatcttctattctcctctattttctgctattggtgcatgaagacaatagtgagaagattcccccatggatctgggaatgaggaaaatgaattaaaggagtgtggattttgaagtttaactctttctgggcacagtcacttcaaagagacagactaaagcccaggccagcatggccatgcctgttggatgtaatagaagaacgtgtccatcagaagcatggtgggtcagggttgggcagcacagggcaaggtgattcacggaggtgggtaataagaaccattcactggagctgaagcagtattggagtattactggcaaagtcaacgtggataaagattcagtgagtgttgtccaaagacctcgaggatttggggtcattggcaagaacttccattgtacatttgtttcatccgttttactttgatcagattcaacgctcactagaaaacctttgcattattccttggctttctaagtcaatatgccaaaaaaaaaaaaaaaaaaaaaaaaaaaccacaaagctcagtattgaaactctgaaatatctagtttctggaaaagttattctcgctgtaaattaatacatttatagttcgattatgattttagtgacagagcttgttgtgttgggatatttatgacaattggatatatacagtactatacatttgtaaactgtccttttttatttcacaaatgtggttaagtgagtctgtccttgagaggaggaggtcccattcctggaaggtgggtgtcatcggtttcttagcctagaaggttgagaaccacatctgggaatatcataaaaccagccaggcgacagacatcacgctaagcctcaaagcctctcccaagataagcagcccctctcccccaggatggacatgctgttcatattgaagttttctacaaacaacagcaacgattcttaaaactataaagtggggggctggataatgtgcttattttggagacagtagaatacaagaagatggtgctcagtaacatagtttaaaaacaggcctgggggctgggcgaggtggctcacgcctgtaatcccattacttcgggaggccgagatgggcagatcacctgaggtcaggagcttgagaccagcctggccaacatggtgaaaccctgtctctactaaaaatacaaaaatttgccgggtgtggttgtgggtgcctgtaattccagctactcagggtggctgaggcaggagaatcacttgaacccgggaggcagaggttgcagtgagccaagaccgtaccactgcactccggcctgggcaacaaagtaagactccatctcaaaaaaaaaaaaaccaaaaaacaaaacagaagagctcatattggccatggaagaggcagaaatgtgaattcttacggttttctttcatggacggatattagtctcaacatccacagccacggctgggcgcggtgactcacgcctgtaatcccagcactttcggaggccgagacgggcggatcacgaggtcaggagatcgagaccatcctggctaacaaggtgaaaccaagtctttactaaaaatacaaaaaaaattagccaggcatggtggcaggtgcctgtagtctcagctactagggaggctgaggcaggagaatggcgtgaacccgggaggcggagcttgcagtgagctgagatcgcgccactgcactccagcctgggggacagagcaggactccgtctcaaaagaaacaaacaaacaaacatccacagccacgctcttcctgaatggccaactcttgacttttcaagcactgagccagttgggggacgattttgaatctctgcttctccctcttccaatgtcctgtttcctcactgtttagtgttagaaaacgaaacttggtagtggctgggcatttgctggtttggaaagagtatcgaatgtaaggtgtgaattttttaaaggtttaatttgtgcatttgtgcatttgttaaacatttctcattggctttgagaattaagctccaactacatttcagcacactttctgaacactgacaacctcttgcatgcgcaatctgcagaatttttagggttgcctggtttccatttgtagaactgggtaagaacgtttacgatgtcagcaagtccatttgattttcagttaatggcacagatgggaagctgctgtgaagcgcctgatggagggtcaccaggaaaaagaagggagtgggggcctgggctggacaggggatggatgagaaggcagtggctgccctttcacactttgtcaagggactggggggacaagggatggtaaggatggaagagatgcataagcaagaagaataggggacagagggagaccacatctctggctgggctttacccaacaggcacctcctctgcaggaagtagctttctccaatcctaccgtggaaaagccacctgtgtctcttgccccagttccaatggcaccagcaggaatggtgccccagccactgttggctccctggatggggtctaatggttcagccacagtccatgcatcatccccagggaaattcacagttctagccctttcattacaatcccgtgtgtgtgtgtgtgtgtgtgtgtgtgtgtgtgtctgtgtttcaaaccatcgtgtcctgacttttgcatattctgtttggaaataatgtaggcaattgtttcatattaacagctaactgcttatgaaatttcatttaagatacataactgaaaaagcataaaaatgtccaaactctctcatttaaaaacatcactacaagctaagaccttgtatgataatgggtaagtgcaatgttacaactgaattaagaaaatggcagaaataaattccatgaaggaaggatgggagaactttaatgggccttccatacccttgatgtggggaatgaatgttaaacagcagcatttccaggcctcactctggaaatatatccaaggacagtactgtcctaatatggtgataatctatgtgaatacaattagaaaattactctcttttagcaatatttaagattgacttgtacattacaaggcccaacaaatttactagacaacaattccgttaatggcttccttcttgcttttcactcctctattccccaatcccttattcagaaagatgtataaatagaattcacccccttgatctgttacctaagataggcagttacgtatttgatcatggttacaggtagattctttgcattcatttgtctaagacaaatactactaataatgatattgacaatgacaatgggaataaacaataacaaagtgacaataaagcacctatcatgggccatctactattcaaagggcttcagaagcatcctctcatttactttataattgccatgtgaagcaggaatttttttttttttttttttgagacggagtctctttctgtcacccaggctggagttcagtggcgctatctcggctcactgcaactctgcctcccaggttcatgccattctcctgcctcagcctccctagtagctgggactacaggcgcccaccaccctgcccggctaattttttgtatttttagtagagacagggtttcaccgtgttagccaggatggtctcgatcccctgacctcgtgatccgcccgcctaggcctcccaaagtgctgggattacaggcataagccactgcgccgagccagcaggaatgatgattaaccattttttaagatatggaaactgaggttaagaaaggctaagtaattgaccaaggttgccaagctcgcaagtggtggagccaagatgcaaacccaggtctcaaagcccacgtgtttaataatgaagagccctcttatgttcctggtgctgtagccactgactctaggacaaacctacatgtgtgttgaaaagcactgtccttccccagacagctggtaaccctgttatcttacatggacacagtaggagccctacaaacatgtatatttacaacaaatatccaacccctatttttagtcttatttataatgcagcttgagtaggtagacctggtaaatgtaggataaactattaaaggtagaagtaagccaaatccttctatccacaacctgcttgctttagcatgcaggagtcaaacgggacacatgtagccctgatacctcatggacttctcattttaaaagagaaacaagaaggagtgtaaggagaatgctgatgagctttggagatagggagaccaggttcaaatctgttcttttattacgtgaccttgggcaagttatagaacctctctgagcctccatttcttctctggaaagtgtctgtgcgataataaccttatcttgtagagttgttcagctgaataaatgagatagcacttagcacagttcctggcacataatgagaacataattcacattagactttgtccaggcttggtgactgacacctataatcccagtgctttgggaggctgaggggggaaggtcacttgaatccaggaatttgagaccagcctgggcaacataaccagaccctgtctctaaaaaaaataaataaataacaattagccaggcatggtggcatgtgcctataatactagcgacctgggaggctgaggtaggaggagtgcttgagtctaggagtttgaggttacagtgagctatgattgagtcactgtattccagcctgagtgagagagcaagaccctgtctctaacaacaacaacaacaaaaatcagaatttttttttttttttttatatggagcttgatctcagctcactgcaacctccgcccctcccaggttcaagcgattctcctgcctcagcctcccgagtagctgggattacaggtatgtgccaccatgcccggctaattttgtatttttagtagagatggggtttctccatgttggtcaaaccagtctcgaactcccgacctcaggtgctccgcctacctcagcctcccaaagtactgggattacaggtgtgagccactgcgcccaacctatttatgttgtcgtcgttttttttttttttttcacttctttaatcaacaattttaagagagactgttgttgattgtgtagagggcaataaggtagaaagctcacagagcatattttagacttctgggccttaccaagtggtgcagtggccagctgtgatgctcttaactgtgaggccaatggatggaggctgagctcagcaatgcgaactgatgggcttttactgagaatctccacttagacaggcatgggggcagggaagggagatgctgtaagcaaaagagaaactaacattccaggaatacctaccatatgtcagttaccacagtgaaaatttgtttcgttactgatagtgatgcctgacgtaaggtaaggtctctactttgcagagctgtggatacagtcagaacaatttcacttcagtttgtaaatgtatgaaaacaaaagctatgtgtatttcttaaagatctcaaacaacaccagtatctgtgcagacagggagaactacaaggggatgaagttccagaaaagggtgttcttactttctaatgtcaaaaagtctctaaactgactaattttctctctaaatataaattatgatgatgattattttacagactggggtccggttaccagcccctagagtcacatacagcatctgagccctactacaatagtccttagacaatctagtacaatctatacatttgaaacaaacattccttaatttattattgcagccagatattgaaataagttatagcatccgaacattgctgttcagcccctagaagagaaaaagcattttccagggacattttgcttggagttcataagagggtgaaataatgtaacaatagaatctctatccccagccacctcctgactaggcagttctacctccaacatcaaagctgctgcattaaaatttaatttgaatttaaaatccctgacagggcccaacactggggaagcaggggttaaccactgagataatgaggccatcgctgccaccgctgattctgttgacagtattgtatcacctaatgaatgtggcgatataaatcttgatgaggggcaggcctgagtctctggaaaagtaatgatcatgaggaagaggcaagagcccatgctgcagacgaagaggaaaaccaagaacgtgccccagcccaggaggagcaggctgagacctgggcccgcaaagggcaggctgactggccctgtttatttacccaaaatgccccatatttcatcgtgcaaatcatagggcctaccatgtttgcaggatttgacggaagcaaacaaaaggtaatgagaagcatgctatatgcttctaagtcaattctccactggcccagcaaagcagacctatgacaattaccaaaaacaattagggtagtctcatgatctctctctttcttctgtggcagaaagaaagcattttacaaatctgaatgatttgtgttctcatctgaagtctctactttattttgactgtgatggatagtaccatgaattgctttggcttttttcagttaacaagtttggtgtgattcctttgctactgttccttcccaaatgtgctccaagggctacttggcaagacaaaggacaaaaagtaaactaatcagctgggcatggtggtgtgcacctgtagtctcagctactcaggagactgaggcttgagcccagatggcttgagcccaggagtttaaggctgtggtcacctagaatgccccactgcacactagcctgggtgacagagtgagactctgtctcttaaaaaaaaaaaaaaaaaaaaggactccctgaaatgccccattatagaaaataaagattccatgaggccattataaggatgaggtttgatgtgtttcaaatagcatgtgaacacttcagcagcccctctggactctacctagaggacactgaggcataaagatgtcctgcaggtgtggcccataggtggccgtgtgtgccaggatacgggatgttgggagtctaacagccaagagtgctccttgactttttttttttttggacagaatctcactctgtcacccaggctggaatgcaatggtgtgatcttggcttattgcaacctctgctccccaggttcaggtgatgctcatgcctcagcctcccgcgaagctgggattacaggcgcctgccaccatgcccggctaatttttgtatttttagtagagacggagttttgccatgttggccaggctggtctcgaactcctgacctcaagcgatctgcccaccttggcctcccaaagtgttgggattacaggcatgagccaccatgcccagcctagtcctctttgactttgcagaccagtggtccaggctttacctgttccgaaagctgtgacattgggaggtgtccagcacattgatgctggagcagtctctgatctttggtggagaaggagactgatgttggagagctgataagatcggcctgcattgctgtgggctgtgtcagatgggtggaccctcctccaattctagaagtcaggaaatagatttctcactgaaagaaatctggacatgttcagcatctggacactcgatggcatcttgaagggaccagctatctttttccagaagtctcaaatctggttgtgtatcagagtcctttggataacttcaaaatagaaattcttggggccatccctacagaggttggtttaggaggacttgggcagttgtggcctggacataaggacatcctttgtctttcctttttattctcttatttttaaagaaacctcctagaggtgactatcatgtttctggcggaagaaggaaggattagaggtaaaagtgtggagcaaataggacagaaaaaaatgggaagtcaaacttcttcagagcttacatcagggtcactcaatcttggatctactgacatttcagacaggatgattttttactgtaggggctgtcttgtgcattgtaggatttctagcagcaaccctggcctctaccctccagatgcctactggaacctccatcagtcgtgccaatcaaaaacatctccagatactgccaaatgtcctctggacagggttagggggatacaaaattagccccagttgagaaccactggcctagacagtcctagaggccttgcaatgtgggcacctcaacaaggtcccgataccaagaaagagagaaagatcattgccaagtccctcatggcttaatgcaatgagccagtctttcacctcatgattatatttggaaaagaaacttgattccagctttttttttttttttgtgacaagcactcatttaagattctcttaacactaaagagaatcttgcagtgtgcataagcctttcttacggcttcaatctgatccggcaagagcatcctcaagcccctacctctgcaaagaagcggagatgaaacctggacaagggctgtgggtgctgcggcaaccacaaggcccgacagagtccatgcaagccacaaacccacgcaggtgcgccccaacctgtgcaccagccacacacggggacaccctcttctcattccaggtagtgttgaccaggaaaataaaaaaaaaatccccttttattaacaaagggagacagaagacaaaaggagcagaagatggaaatccttcaagatctgtcttagcagaagaaagctccctttctctttcttttccccctttctatgccctttctatttttcctctgtcttggttctctctttcctttgtatctttttcccttcctcccttctctttctcttctctctcatcccctccttccccctccctttctcctctctctctccctctcatttaaaaatccattcaattggcttgcccagcaaccttacagaaacttctctcaagagcagcctattgagactggctctcaaattgcccccagagcccactggatattccttcagatgtctaacaagcgttgaacacaactgaggtttagagagacacagaaatcaatactgcggcttccaccagtcacgctgagggattagttgtcccaaggaaaagcacagacagttgaataagagaatcatgactccgaataccctaacaggtttatgaactagagagcagcctctggccttgataacctccagttggcctggagaaaaaggaggctgtgaaaacattcacttagctttctccccttttgtattaatgaggtcaagcgtgggacctcagggagtcaacagtggtacttggaggaatgactgtcaaggccggtgggtgacgatgaccatctgagcagtggcattcagaggctctgagcatcctccttgctgtggagaagtcagtggccacatccctcaggacagagcttgcagggaggctagaactgagggcaaaatagaaaaacagcaatgccttggactatttgctttgagcaggtggcattaaactgtggcaggtgtttacatttttaaaatcatggatgggagagatcaacagagtatgcaaatgattaggggactctctaaatgggcaggattctgaaacagcaaagagcaatggagactttttttttttttgagacaggatcttgctctgttgcccagcctggagtacagtgatgtgatcatagtgcactgtcgccttaaactcctgggctcaagtgatcctcccacctcggcctccctagtagctaggactacaggcacacaccaccatgcctggtgaagttttaaattttattagggatggggtcttgctgtgttgcccaggctggtcttgaactcctagctccaagcaattctcccatctcagcctcccaaagagttggaattacaggtatgagccattatgttgggccgagcaatggaaaaatgttaacagcttctccactttgatgagaatataatgagagaaggctcatttcaatgtataaaaattctcatgctcctacttcctatgattcacattccggaggctgatcttacaattgacatggacattccaaacacctcacacaaataagacacctggttggagactcatttaaaaacagatggagccaacggcctcaatgatgtcagtctcaacaaaaagagaaaaagtcactttataactggatctctgggtttgagtgaagaattaaagctattatctgtataagtcaaaccaaaaacctaccttcctatgaatttataggacaatttaggtcctagctgaataattcagaaaaagataatcacctcaattatttagatggccatctcattcccttatatactccatctctctaacctggatgtggaaagtcgacagcaattaagtctcttaaccaagccaccaacaggaggccaccgatttggactacaaatgtggcaccctcgaaacaggatcagtggaaaccgaccaggattaagaaactgatttggaagacattggctctgaatcactaagtgatgctcacccaatctgatggaggttcaaaaaccctaggtggaaaaaaaaaaaaaaaaaaaaaaaaaaagaaatgtaggaaagtcatctctctgtgttgtgtatcctcaggttacctgctctacccttggtcctgcatagatgtcactgattctggaagagaggaattcagtgcccttctctggcagcctcccaccagtctcagcctcacggagcttgcagaagagcctcatttctggtctgtgtccaggttcagggtgtgagtcggaatttgtgcctccaaggctggttagccagcagcatgagaaatgatgtcatgtaaatagggcagatgaagagctgggagacccctgatgaagttcacaggggtcatgggaaaagagcccttcctctgggtgactttggaacaatagtgaggtcaaactggctggcggggctttgccatgctgtttctatctgggtggagacatacgcaccttgaggtccccgcgtgcctctgtgtgtttgtgtgcacgtgatcttatgcgcagagaggcagggttgtctgctgtgtccaggctggtggattcagctttcctttgtgcaagtattaatctgcccggtcccatcccccactctctccccgcacattagcctaaaatatgagcgcatgctcccgtctcgcctgtgttggctgctctagtgcccacagcatccctgcccccttcctccagccctcttatctaaagcagcatgtcactgcaattttatggccaacattacagactcaagccctcctttgaaccaatcaaactgcactaaatatgttaagggaatccaggcgttctgtaaggagcctgcttcctgagcccaccgcctgacctctctaagagcagcctccataaatctgcctcacctgatgggagatgggctttttaggatctctcagggtgctttgaggtagcacttctatgaactccttgccacaataaataatgctacctgcaatatgtctttgggagcatgtcagtagctgctgtcctgctatgaatttttattcttgtgccgtctggaagatagattccagattcagcatttccctgcacttactgtcagatctctttacccccttgccccagcagaatgacagagaccacaaataaaataaaataaaaaattaaaaaaaaaagcagcctaggaaaaatggcccaagatcggagagaaagagccaagctcacctcacagcagcggcatgagctgccaacatgaggcggggtggccaggtgggaggaaggtgggtgtaagctgggcaatttcagagtcctcaggacggaagcaattcaccaggggagcctggaggaaggggtctcttactaggtaatggtgtcagataagaagaaagcccaagtttgggtcaatacatcattatgaaggagagcaacagaaatctgttcacaaacatcagttaggtggtcattgccctggtaagataccgggcaatcagtccatgcaaagaggacggtggattcagaaatagcccagagatgacttccaaagtgagatgttatggtcagaaagatgaggaagaaagacacccctgcagcttaggaataacaatcagttgcttcccagatttcactaactcacatgtctttgctgatccagaagcgagcgctcacatggccgtgtgcattttcctagttatcagccctgcaacttcagaccaatcagcagacctgaagccaaaactcaccgatgcccaggaatttctgcttccttgtagtgccccaagttcctgggagtttctgcatttctaacttgccagctatatccattacggtgggcgaggtgcccaggaaaggaagaaagaaaagctggctttgatatgttaacatctcatgatggtagaatattttatgttataggccacttcctctttggagagggtacagttcagcatcctggcaggaaaagcacataggcctagcttctctgtgcatggagagccacacagtcacagactacaactttggcagacttttaaatgaaagttttgccaactgtgaaacagacaggaattacctggggatcttcaaatgcggattctggctcagtggaacccgcaagtctgcatttcttacaaaatctcaggtgacgctgacgcgacctgtggaccacacattaaggaatgaggttttaggttctaccaagtttctactgcgtacctactgttctactgcgtacctactgttctcctgccctagagtgtatatgtggctccaaacccaagagaacccagtctgtttctgttctcaaatagtttgttctttgttcttcatatcttaaaaaaatcaatatagatcaaaacagagttttaaaaattgtggtgatttgaatatctgcatttaacacatgaatacttgttttttgtttgttttgagacagagtcttgctgtgtcgcctaggctggagtgcagtggtgccatctcggctcactgtaacatccagctcccaggttcaagcaattctcctgcctcagcctcccatgtacctgggattacaggtgcccgccaccacactcagctgatttttgtattttttttggtagagatatggtttcaccatgttggccaggctggtctcaaacttctgacctcaaatgatccacctgccttggcctccgaaagtgctgggattggaggcgtgagccactgcatctggcccgcatgaatatttttcatgcctccaaatggaatatgccatctcacttggagatgatgacaagaatccatatttgaggttctctgtgagtgtaagatcaaggccaatttacctctgggcccagcagtgacaggctgctagaccctcccacagggaatcagatggtttatgcagaatgttggcttcatgcggtggccaatgttctacccacagccaatgctacgttatcatttctagcctcctggggcagtgtgatcaatttcccagcttagacattactgagagaagggtatagagttaggtgaaggctaaatgaaaaccttcactgatcaagttaccaatggtgggctggtaagtgggaccagttcatttcctacacaacaagaacagcaagaccacaaaactgacaacataaaatggaggtgataagatcactgacaaatgcctttttggatgataaagtctcttatggttaagatgatctttggagtaagaagtgcagaagcttttcatacatcccaacatgtttaaatacagtagctgaggagatagcagcccctgtccatcaagtcatctgaggccaaccatcgtacacatgatcactcatttgtaaactgggcttcctgcctgctgaatacctttgaaaaacagaagttctctcctaattgcctgggctgacctatatttagaaaactgaaatgtgctggtacagtggagaagccagaaaaatgttggagttaatcactaaatcaatctgggctgaccccatgaggatagtgagcactgaaggttgttggccaaggagcttttggaggctggacttaaaagaactctcttgtttctctgaaacgggaaaaactgcttctttctgcaaaaacatattctaggatagtccttcaaaacagtcacgccagtagccaagtcaaggttaacttcattttgttctggtgtacacaggtaggtaccacagctggagaaacaagagaaataggctcattctcaagaggaacccagcgaggagatctttcttttcttcccttctcacccttggccaactttccttctcttatatctgtttggtttcttactatcctgggttgttaaaattcacagttgaaattttccttaaaattttatacccacgaggtgatgataatttcctaaagttcagagtttgaaaaattgggggaaggcacaagaagtattcggcattattttcagattaaatgaactgtgggatgacatttggaaatgggcaccaggtaccttgaagatgagcaattgcctttacaggaacactgaacagaaagttcaggaagctccttaattctgtaggaccagcactcacccccaaatttgccagctcccgtgatttctgcaacctatgctaaatgatggcttgggtttgaaggctaaaggatataaacagccaaagagggggaaaaggcacttagaactagagagagttaccgatcatttgatttctgtagaaaatacttgtcggagagataagtaataaaaaatctagcacatattttgagatttaggtttggctgtctacctagttaaaagtttagattgagttatctgagccatatgcatgcatatatatatatatatatatatatatatatatatatatatatatatatatatatttatttatttatttttgagacagagtttcactcttgtcacccaggctggagtgcaatggcgcaatctctgctcactgccacttccacctcctgggttctccgctcaatgccacctccgcctcctgcctcagtctccctagtagctgcgattacaggcactcaccaccatgcctggctaatttttgtaattttagtagagaaggggtttcaccatgttttccagggtggtctcgaactcctgaccaggtgggagttcaccagatggtgatccacccaccttggcctcccaaagtggtgagattacaggtgtgagccaccacgcccagcctattttttaattctcgcattgaattttgtagtgctaagctaggaaatgaggaacttgattaagtagtgttacaatggaacaacttatgcatttatcgtcaacaatttattgagtgttttcagaaccatttttgagaagacatatgagtattagactttttttttcctgcaggaagtttacattcttaattgttgagatgggactaagttactaaaacatattatatatattatattaaaatatatcttaaaaatatatagatatgtaagttaagtacaaaattatatgacatgatatgatagggactacacaatcaagctaagaatttggagaagcagaattaccaatgaggaagttagatcccatgacaggcttcctcctggtagggtttatatagaaaacaagaaagggtgttccaagattgtggaacacagatgggaagctatgaagtttactattttttattatgattttttaatcttttattttaggtccagggctacatgtgcaggtttgttatatggtaaacttgtgtcatggggatctgttttatggactattttgtcatctgagtactaagcctagtaccccatagttgtttttttggatcctctcccttctcccaccctccactctcaggtagccccagtgtctctcgttcccctccttgtgtccatgtgttctcatcatttagctcccacttacaagtgagaacatgtgatatttcgttttctgtttctgtgttagttttctaaggatgatggcctctagctccattgatgttcctgcaaaggccataatctcattcttttttatggctgtgttgtatcccatgctgtatatgaaccacaatttctttatggagtttaatgtgcactcctgcaaggaaactagtccacagcagtggaaggaacccatgagggggttgtgggaaatgaaatttgatgatgtgggaagcgacagatgagagtggggtttgcccttgattagcagtaaaggaagatactgaaagttacttttaagcagaggagtattataatgggaacatgttttgacaaactggggcagggtctcagagcctcaggcatgtactctcaggaacttagagaagagagagttaagccctttgaatttgatccagcaggacaataatgcttaacagaggaacaagataattctgagtatagcctcagtatcctcaagtagtctgagacctgtgaggacaaaaatagcagtttagttaaaattctgtaaaactttaggaggcataaacatgctttgggactcgttttttcttgccttttttttttttttttttttgagatggagtctcactctgtaacccaggatggagtgcaatggagcaatctccgctcactgcaacctccacctcccaggttcaagcgattctcctgcctcagcctcctgagtagctgggattacaggtgcccaccaccacgcctggctcatttttgtatttttagtagagacagggtttcaccatattggccacactggtctcgaacacctgaccttgtgatctgcccgccttggactcccaaagtgctgggattacaggtgtgagccactgcacccggtctgctttgggactctttctaacagagacaatggcaaaaccatctgaggtggtggtggtggtggtggtgaaatgggagcattccaccctggcaggaaagctagttttattattgacattattagcacaggatgataagaaaaagtgaccaatttttagctggtttatgattgttgtaaaactctccactgacaatgcattcctttgctgtctgcactcggggtcactgctcttgctctctcctttcctgcatatgcaactgaagagacaaagaccagtagctctccatgggggcaattttacccccagggaaatttagtaatgtccagagacatttttttgttgtcacaactggggtggcagcagtgctgctgacatctaataggtagaggcaaaatatgctatagtacataggaccatcctcacaacaacgaattatccagtccaaaatgtcaatagtactgaggctcagaaactgatatacaccaaggtgctcaatgaagcattatttataacagcaaaattctggaaataatcctcatttctaacaataaaagaatcgttaaaaattattgattatcatatgtccacaggatgtactttgcagtcatgttttcaattataacttgatataggctcaccctgtaatattaaatgaaaaaaaaaagaatcaaagctgtgtatacatgcaatcccaattttgtaacaacaaatgcatcacacacatgtcataaacacaaacaccccagccaggtgcagtggctcacgcctgtaatcccagcaccttgcgaggccgaggcaggcggatcacctgaggtctggagtttgagtccagccaggccaacatggtgagaccctgtctttactaaaaatacaaaaattagccgggcatggtggcaggcgcctgtaatcccagctacttgggaggctgaggcaagagaattgtttgaacctgggaggcagaggttgcagagagccaagatcgcaccactgcaatccagactgggggacaagagagagacttcgtctccctccacaaaaaaaaacaaaaaacaaaaatacacaaacaaacaccccaagacagaggactgttaataagtaaccaaaatggatggatgcagtggctcacacctgtaatcccagcaccttgggaggccgaggcaggcagatcacctgaggtcagaagttcgagaccagcctggccaacatggtgaaaccttgtctctactaaaaatacaaaaattagccaggtggcagacgcttgtaatcccagctgctggggaagctgaggcacgagaatcatttaaacctgtgagacagaggttgcagtgagctgagattatgccacagcactccagcctgggcgacagagacatactccatctcaaaaaaaaaaaaaaaaaaaaaaagaagtcaccaaaaggccaacaatggttatctcttgattcgtagataaaaatgtttgttctcttctttgaacttttctatatttctgaaatacgataagcatgaattaattttctgatcaaatataatttttttccaaaacacctcagtgatttgaaacataggccaaacttaacaagacgaaatataattggaccgtgcaacatttacatataggttcaaagcatcaattgtcaaaggcaggagtaagatgcttttgcttatgacccatttatgtaaaaagggtgtgagtcaatggaagctcaaaatcaaacagaagagaactgatgaggttgctgaaagagtgatctaaacttaggacaccttaacaaaattttgcaccaggatgacgcatgcagcagtcctctgtggggcacttatctggactgctgaatgcagtggtgtgtgacgtattttaagggggctgttgaaaacctggagtaggtccagatgacagcaaccaaaataaggagcttgaaattgtgacacgtgacaaaaggatgaaggaagtagtaaggagcttgaaattgtgtcacgtgacaaaaggatgaaggaggttgggatgtttagtctgacgacaagaacacttaggagaggtgtgagagctatctttaaatatttggagggctgtcataaggagagggacatatgtgctgtgcatgggcccagaccacagagctggcactaatcactgatgagaactgatcacttatcttctttcacataacttccaaacacaaagaaaaaaaaaaactcttctaaatcttagagttgtccaaaaatagagtggctaacttgggaagtcatccagtcccgatcactgacttaatgatagtgtgtcaaggttgttgccgagaggacagtgggctgggaaaatgagagagcagcgatgctactcatacattcctggtgcctattgctcaatgcatgagcaaatgcagaggggtcaacattcattgagggctttcagtgggccatggaccaggaatggtgccaaatgcttcacacgctctgtccaacttgttcctcatagccaccttgcaagaaaggcacaactctacatttgcctcgttttccagatgaggaaatacaggctcagggaagtttaggggcatgctcaaggtcaacagctagttaatgtatcagattctacagcaatgccaataatagtaatagtaatcatcataactgtagttgcaaacatttgtataatgcgtactatgcatcagagttcaaaatgctatgcctctatcctcattttacagataagttttgggtaggtcaagaatcttgtccaaggccaaaaatgggtcagtgatatggtttggctctgtgtccaaacccaaacctcatgttgaattgtcatccccatgtgtcaggggacgggcctggtgggaggtgactggatcatgggggcagatttcccccttgctgttctcatgatagcgagttgtcccgagatctgatggtttaaaagtgtgtggcacctcccccttttctcgctctctctcctgctccgccatattaagacatgcttgctttcccttcaccttccaccatgactgtaagtttcctgaggcctcctaaccatgcttcctgtgtagcctgtggaactatgagtcaattaaacctttttttccttataaattacttagtcttgggtagttctttatagcagtatgagaacagacgaatacagccagattctgtagtaatgctaaaagagtaatagtcatcatcatcacaaccacagctgtaaacgctcgtatagtatgtactacgtgtcaaaaaacacagtttggaatgctgcacctatacaacttatttaccataacaccctaagggatgtctctcttattgtccctatttcatagatgagaaaatgtagactcgaggaggttgaagatcttgctcaaggtcacacagctaatgagcgatacacctgggttttaaaacctggcacttcagactccatagcggtattagtaacaatagaactaggaatcctcatcatcactgtcattttcccagtcataaaaatggcacaaacatgtacacagcccacactatgtgtcaggcaaacacagcagacctaggaggtagtatgatgcttaattttatgtgtcagcttggagagtggttttggatgagattaacatgtaaattggtaaacttcagtcagccacggtagctcacacctgtaatcccaacactttgggaggctgtggccggtggatctcttgaactcaggagttcgagaccagcttgggtaacgtggggaaaccccatttctacaaaaattagctggtcatggtggcacacacctgtagtcccagctccttgagaggctgaggtgggaggatggcttgagctcaggaggtggaggttgcagtgagccaagattataccactgcactccagcctgggcaacagagagagaccctgtctcaaaagaaaaaaaatctggtgagctttgagtaagcagttgtcctctttaagaggtgggtctcatctaatcagtggaaggcctgaatagaatagaaagataggcctccctgagcaagaggaaattttttagcaggttgtctttggacttcgtctgcactatcagcactcctgagtcttgagcctgctggccaaccctgcaaattttggacttcccagcctctatactcactccttgtgaaccagttccttacgataattctccttttctgcctgtacctttcctattggttctgtttttctgcagaaccctaaaataggtaggtacaactattatcctcattttaatgagagacccagagacattcaagaactgggtcaaagtcacatgactaataaatggcagagccgggatggaaactccaaccactgggctctgtagtccgtgctcctacatggcattctctggagctccttcctctcaactgctgtgtgtgttatgatctaggtgacatgaaatgaggggatgaaaaaggtaaactctcaaggcaggaaagttgctgttcacagagaaagaatgacatccctgagctgctcctcctaccaaatggccacttactcattcttccagatagcccttgccacattaggacatttcttaatatttgacagattgaagggtaaaagacccaacaacttttcttcctcctggtattgttcaattcaacagagaaagaatttactgagcaccttccactttcccataagttagaggcaactgtcttgtctcctgactcttgattctcattagataatttgtgatttgaatacagaatatgtaaaataattcaggctgggcgtgatggctcacgcctgtaattccagcactttgggaggctgaggcaggcggatcacctaaggtcaggagtttgataccagactggccaacgtagtgaaaccctgtctctactaaaaatacaaaaattagttggatgtggtggggtgcacctacaatcccagctagtcagggggctgaggcaggagaagcgcttgaacctgggagttgcagtgagcaccactgcactccagcctgggtgacaagagtgaaaactccatctcaaaaagaaaaaaaaaaaaaagaaaaaagagcatttaatatagttcaagtgacatataatgatacaatgcctcctcagcttcccctatgtggtggaaatgcacaagtactcacgttgttgccttttcaaagttttgaagccttgccctgatatcagcaatttctatagtaaagtttctaccttttagtttactatacctctcgctgataggaaaatcgctcttgatattctcagtttaatttcacttttgccagatttccattaataccggtatctctttggaccatccaaagccatcctcctctggaggcttatctttcacataatttccaaacaaaaagacaacacagacaaaagctgcacaaaaacatgccatgggaccaggtattgaaaaaaaaagacattgaaacagacccaaacagaaatacaatggttttattatatgagccttcagcggtaaagaagaaaggaaaaagcaaggttagcaaaagaggaaaggaaagcaaaatgactagcaaacgcaaagtgcctaaggagatggtgttttctttgtatgcatcaacatacactcaaagaatatttccctataagggtgtcattgcccactcacttcccgttttcagttatgtgtaagagaagcttttaactctattttcagcccccctgggagttgcaaggaagaaggtgttgctactaaagtaggcaatgctcagcctgaaagtcaaggatacacaagacgcatacccatcagcctcctcgtcctgcctggaccagccctccctgacctcttagtgggggttggaaaccgctggcccgcactggccagaccatggggagaggctctcagaggacagtgtctcctttgttggatgttttatcacaaagaaggtgataccacaggaaaaataaatccggaagcttctagtctaacccaaacctcaggtgttctagcaaagacagcaggagaaaaatccccattgcatatctctatcttgcagtataaccctgaggtcagtgaaggtcattgaggaaaaccaacctgaatgtagagaaaaagcagggtctctggcaatacaatttaaaggtgacaggacacgaggctttgtttccaggcacaggctgcctccctttcttgcagtggcagcccctccagacctgcccctttatgtccaccccaccctcacccccaacactcttgactgtccacaggtcatcacctatgctgggccttccccgttgctctcaactcacaatggactgttccttctctgacctcggatgatttaagtcatctctaccattcaacctaatacctagtagatactctttgatattcttttccaacggtttcatgtacacaggtcttttctaccaaataatattccatgtgccttgaaagaaaggatctcgtcttatacttgttgggaatcccccactccactagatctagtactttggtgacctcagcaaattcttgcgataaaatgcttgatttttatcacctccctacctatacttccaaacggttgctatacttaggccttcacattcacgctgcactcctgaccagtgaatgcaaacacacaaggcatcattttgcagaaaaatccggatatggtggagaaagaaattgtcatttctcaagattcttgatttgtttcttgagctaaggggagggaaatgcttgccagtgtttcctggctgattttggtatcatgctgttggcccttttgtgagatgtgtaaagacattttactcaatctgtgagaaactttgatacagacagaggaacttggagactagccaggcctctttttaataaacacaggagacgtgagatgggcaggtctagggtgatgggaagaggtgatactgaatttcatttcttagctatatacaagggaataagattattcttaagaggggggtgggtggtggtgaaaacaatacccaccatgatactgatgggcaggtctggttgtataactactgctgaggttcaggaagctcccaagatgagacttccatgttccagggccgctttccctttaaacagaagccggggggtggggtgggggtggcggtggtggtggttatggtattgttctggcttcagtattaatcttgctttcttcccacttgcacctgctaatgttacccggcagagtcacagccatcgctgggcccttcccccactctaagtttatttattgtggctattttaccagctattggctcaacacactatactcaaatattcatcatgtagctctctgggtaaatcgtatttaatcagcacaggagagaaaatagcataattatagatgccggatgccattacactcagaagaaattaaaccctgtctcaagccgaccagcggttgctgtgattgcatcactgctggggttatggagaggttagtggccattgggggccagcagtacctcgtaaggatgcctgacccagatgagccctaaggagacccactcatgcacatacacatgcgcggcatcaaatactcatcaaacggcggccagtaaattaatctttcattgtttggagaatgtgataaatgagagggataataaagccaggttcacgcatggagatgaagggatggcaaataaatgggcccagagaattccagtcctaaaagtggatagagggaattcccattcccaatctttcccagagcatttcttgccaatagccagagtgatactgacaattaaggcaaaggagggtgacaacctttacaatgaagcaaaagcatccatttgggttatgagtccttacagggaatcctcccagctacagaggataagaatgcaaatgccaaaccagaagtgcacattagtcctggtccttgccaggtagacttgagtgtctcacatgcaaaagtttccatgtcagtaatgccagtgagttgttttgctcggggaaatggagaaggtgaaaagttgcaaaaacaaaacaaaacaaaataaaaccccaaacccaaccataatataatatcagagccctacctgctgaaatgggctcctggaaaaagctggaaccatggggtcaattttcttccagccattctcggcccgacctcttcccacacacatccagggccacctgcacgtgtccaggtacagaattagagtcacctttaatctcacgacacagcttctctcccctggacctaaaccccaggtcagcaaccccatacagtgtagagcactgtttgtaaaaattcaaaaatgtccaaagatgcaattaggctttacttattactattgggtgactgtttttgcttttttttttctttattcctttttcttctggctaataatgcttctgaggtttggataagtaactaagaggaaggagatctccttctagtccatcctgctgccgacaattaagaaacctcaaagtaatttttgaaaatgtcagcgtctcatttagcaaaaggataaataataaatgaagcgtaatcactgtcctgtgctggtggtacagcttcgcggtgtcattagtaaactaacggtataatatctttgtgtcacagtttaattatatcttgtaattagtttcagcaatggattgcatagagtcaggccccctgagctaaacaaaaggtaatagaacttttcagcgcccctgcataaatcaattatgaaagtgtcctatgctatttgaagcttgtttgctgtaattttatgcacaaagcccaactggcccttcttgcttgtggagggctattcaccccaccccacacttgtctgcagctgagcctgcggtcggcccacacgcagcctggcccactggtgcatttctcaggaccagctcagcagtaaataccatggagggggtgaggtgctgaggggaggggaggggaggtgtggaatggggggggcagaggacgcacaaggaccggagcaggtaatagatgcgccatgtgcaagaaagcagggaatcaaataggaaaagatgtgagggcttggaagaatgattctttatgcttccctgaacaaagatgagaaggttaggagcatcaaaggccaagcaacgttgatgaatatgggcaggcagacgagatacatgtccctttatcattttatcctttcaacatccccactctcgccacgtggttggaattggaaccagcacaggttacttggcaataggggatagggaaggagaatccacatctttaattgggtctaattcgggtcccacagagctcagaaactgtaaagggcttccgagcgttgttgagggctagctgtggtcaccaggcccagacaggagagtcatggagtcccgctgggggaagctaagaagaaactcaggggcggggggttggttaagtccaaatgccaccaatacgtgtgatcatctctttttgatcaaactgtaaggcatggcagagagtgggggtggggtccacattcaaagtcctcatcaagttggctttgaaagtaagtctagtgccacactggcctttctgtttatacaacaatttataggtttaaacgaaaccccgcttgaaaaagcagactgaatcttcctattgtgagcacttcagcaaatttaacaaaagaaagagcccaggcgaagaagaagagagaggagagagacagagagaaaggtccagtcctcagactggtgtgctgcaatctggctggttgctatggcgacgtgatggtttgttcacatggcaacataccttaggtccactattaaaatgatgagagtgaactcggttgcattaaggaaagtgtgctgtatgctaaagcgagtctttatctccagagagagctggacagagactggcatccagtacaaatgagggagaaaaggaggaggaggtaaaggttggaggtctggaagagggaagaaccgcagggatgcaatcactatgaaaagaaagaccctcagttctgtgtctcagtcgagggcctgggattcagaaggtagacaatgagttttgtttgacatggaattcatcgttcaaatcagcccatcagactaatgaccccttatttaaaaaacaaaacaaaacatattccagatgaacctgctgtaccttggctgtagaaaacacaacagtgaacaaaactcaacccatgagctgtggctataaccaatagccaagcacgaatgccacttaaataaaatactctaataaccgcgagggtggcaaattacacggcatttatttatcgaacataaaagtccattgacagctacagatccacatcatctcacatttgagctagtggggaagatttcctttggaaatcgggtttcctgtttcctttaacatagtgacaatttttcctcctactgatgtcgaaagggtggtgatatttcagtgggtattattccaacagccctacctatctacctgtgcttggtttctttctgctatttagcaagcactgctgtggcacacatgagacagccagaagtctctgggctctgtcatcccattgaaggctcccagtggtactataaaccatctgtgggatgtctgaggccccgaaatccccacacccctcactcgtttggcccccttcccacctctctatggctgactgtgctttatttgaaaatctctttaccataaagtgaagtgaagccttcacaccggcaaatgtctcttgaattggacacatggcagaagatgagcttgggactgtgatagtttctgacgacagagatcctaccagcacagggctcagttctaaccatgagccactgactcagttccttctttgtgccaatgctgcagatgtctggtgccaacagagggatctgacccccaggagatcctgtcatggcagaaaagggggaaggcacagtgctctaagacctgcagaaggagctgaatactaggacagagagcaaagccaaccacactcataaattgcctcctccactctcatccccacatttctcctgagtcttacgtgatagaacattgctctctaaaattttctagggtcctatgatacgctctggcttcctcaggagtccatgtaagcagtacagggaagcaggatagctcaggaggcgagatcctaaactttgcattagagacctgctgtcactagctagcctggtgacctctctgagccccagttttctgacctgaaaaatggggtcacagcagtacctgacctcctcaggttgttgggagatttaaatgaggtaacagttataaagggacataactcagtccagggcatgtacattttatgaattattattattccctttggacccagccagttgcagcatacagcattgtttccattgcaactttagcaacagacaaaaacgtgactttcagatgataagctcccgaacaacaggtcaacggctattcacctattttggaagggtccagaataggatgcagcttggacatatttattccagaaccttcttctctacatgctgcaggccaccagagagaggcaggcctggcctgcagctcaacttgccttcttctgctagatgtctttccttttgttttatattttgactactgacaaaacaccagctttgtccctctcccccaaagggtaggcgggtgtctcttcctaagcatggtaaattgtatgtagagaaaaagacagagagagagagagagattgagagagaaagagggaaaccttctggtgcctatcaactttccatgacagctgcactcatgttccctcctgaggaccaaaataactacaaagtgtatgaaatcgttaagcacataaaaatcccggaggtagacgctgagaataaaactcgtgatttcccaaccaaaaggcatcaaagcccagccctcacagttcatttgcttccctccgtcgatctgactttgctcagtaagctggcaacagtagccctacacacagctcggagagcagagggaggaaggctgggcccctgacctgcctggtccaccagcctggtctgcataatgaaggcatgggggcgtgggggagcccagaggcagatgaaatcagccagaaagcactgaaaagagagaacgcatttgaatcttcatggcttttttttttttgcagcttatgatatacttttcacacgtttaatggcgaggcagctaggtttaaagaaactttcccatttaaatgtgccataacagaataataaggttatgcaggatgtcttgatgtatggtcccatcaggtagaatggtgatggaaatacgctgtgatattgaatctgaataggacacctagagaagaatgtttagcttcgggtgttgcagtacaaatgcaggaatagcaaacataggaatagcccttatcttgtaggcagaattgctctcggtttccaatcttccccaatagcccttggcttgggaagtgtttttgtagggagcacagcaaacagaaaacactgaactccaaatgtgtggtgagagctatgctgggtgatctaactaggaagcatccaaagacatagaccattataaggtctgtctccacatttgaccattccctatttactgaacgcccactaatgtgtataaaatctcttcaagtgcatttcaaagtgctaagaagtataaaaaagagtttctactttcaaggagtttataatttagttggaaaataaaatggtctagctgacggtcagcaaactgcagcctggataggcccaaactagtctgccacttgttttgtgtaattaagtcctattggaatacagtttcaatgtgttcaaagacacattgtttacatattgtctatggatgctttttccttacaacgttggggatgaagagctgcagcggagaccctgtggcctgtttaaaatatttactctctggccttttaccaaaagagtttgccaagaacaagagttgctctaggttgggaaggagagcgatcatcatggctgggggtggggaatcatgaaaggataatggaaaggatggcctttcaggagggcctggtgggacctggacagacccagcagagttaagaaggcatccttggtaggggaaacagtacaggaaaaggtgcaaaggaaagaggcagcatgactgtttgagggatggcaagaataaccatccagctaggacagcctgttacattccaaagcagttggcaggaaggatggtctgataagtgggaggaaaaccaagaaagtatgggattcctgaagccaagggaaaagtggattttcaagaagtgagggaacaagggaggtaagcagtgtctggtgctatcattcagaagaacaagagtgtggaagataaaggaatcgaaggaaaataaagaaatggaagtaataagtatggaccacttgctagagaagttggaccaagatatgaaagaagagatgcaggttaataatttgagtaaatggcaaagtcgactgcagaatttgccgggttaaaagagactgtacatgtctttgggtaaaagaggaacagcagataggaaggggctgacgatctaggaagctagaaagtcaggaaaagggaggaggagaaggaggatcacttccagcctctaagaccagtgaagactctgagagagcaaacagacattctgggtagagcagtgggtagctaggcaatgttcccagatggtctccttcatctcataaaggatgaaaacaaaagtgatcaacccatctgggcttaagaggattggcaagtgaataaaatatctgtttaggagccagaagggctcttcaagcatcaaagaaaccttccatgggagccatgactgcttactgtgataacacctcctggcagaggcctttaccttgggcccgagtgtatggtagaggccatgggattatctatcacatgagggaaaaggaactagagtagctgacaagagcctttgagctgggcatgtagccaagtgtagccagactggacctagtggaccacatggagaggaatggactcatattcacagttgcaactgagtcagataggaggcttgctgaaattcacctgggatttgtctgtgatattgctggattgttttttttcctaacagtgtcattcttggaggtgaagaggcttggctcatgtttcaatcatcctgagtaaattagcagtggtatgttttctgctgtaggctcattggattgatctttgagtgtggtagacttgactacagttaaccaatacccattctcctctacttctagacacatgaagggctgtactgcccagctcccttgaagtaaggtattcatttttgtgggaagatcatcaagagaggaagtgatatggtagttttcacaaagcaaactaagtaagtaaagtggccctatgagctttctcattacatgatggagaacaagaagagaatgcaatgatgaaagtgggttaagaaagctgtcctggggatttgagaatgggtgtggcaccagccactacttgcaacatgacacacagaaggagaggcctttggtcaagggagtattaggcttcagaaactgtacaaattagtgaggcttcacctgaactctgtgatttcaggtcctctggcaggagttatagaacttctggagaagatatccattaggactggaagggtcaagttagaatttctaggccctgggtgtggagcacagacctgagagaataatcgtgcctcctgaagttctcagcctcggttttgtgacagcccagagtgcttccaattatctcaaggggatcaacatttgctcttttcttgatcacttttattctaaaaatcaagattggacaggcataaaattaaataataaaaaaccttatatttttgtatagcgcttttggaatttacaaatctcttttgtgtatgttagagctcatctgactctttcacaacctctctggctgcgaagtagagaatggatgataggacagaagaaagaacacagggggccctggagtagtccaggcaagaggcaatatggtagctcagtccaggatggtgccatgaggatggggagaggtggatggttaatgtgaggtcagttccctcaaaataattcatttataagtttaactaatatttatggggctctactatggcccaggcatgtggttaggttctgggtgcttagaggtgctctgtattaagattgcctaaaaatggtgtgggcagtgctaagacagatgtgtgggtaaatagctatggcacaataagagaatggctctaatgaatctaagtgccctaggatctggggtgagtctggtgactctgcctggggaatttagagaagctttccacaggggaggtggccagtccaatgacatggatcatatccattcttatttcatatcatatggccatgccttgcttcaaggtaggtgcgaagtagctcttcaaagtgtccagaagtagaggagaatgggtattggtgaatgatagtcatgtctacaacattcaaagatcaatccaacaagcctacaacagaaaacataccactgctaatttatccatgccaattaaaacatgggctaagccttttcacctccaagaatgataccgttaggaaaaaaaaatccagcaatatcaaagcaatatcaaatgagaagtaattttcctagaagggaaaggcagaagggcatgccaattagaaggagcagcatatacagaaatgcatgtgtcccagaattatggagtttggtctaataatacacacacacaaacacacacacacacacacacacacaaacacacacacacacacacacacaggggagagtatactgaggaggtcagctgaggctatatcgtgagagcctcatgtgattacactaagaaggtggcatttgattgccaagtcatggaagtatcatggaggtttgaagcccaggaaagggatggtccttctacagatggagagatagaagctcagaggctgagcggcatgcccatggtctcagggtctgcagtattgacaaaatactttatcatttattcaatgctactttgtatttcctaacacagataaatcataaagaataatatatcatatgcaacggccatttaagaatttggaaatctggaaggcagctaaaggacagaccagaagacactgaaccacatacgaaaagcctaaagtccaataacgggctaatgttcaacagcagtaagttcagaaatccattctgagccgactttccagttctcagtgcaatgcagtgggtgctcatgagttttaaaactgaagttgtaaaggaatgtagttctgacacataccacaaagaggacgaaccttaaaaacacgatcctaagtgaaagaagccagacacaaaggaccacatatcgtatgagtctatttatttgcaatgccaagaataggcaaacctatagagacagaaagtagtctagtggttgccaagggttgaggggggagggaagtatagggtgtaactgataatggggatgtggtttttattttggggtgatgaaaatattctcaacttagattagggtgatggttgcacaaacctgtgaatatactaaacactcttgaatcctatacttcaaatggatgaattttacggtaagtgaataatatctcagaaaagttcttaacaaaacctgaagctatagcccctatttgggtctccagtgtatttatttaaatattgaaactcccaacatcaacataccttggaggcgatgccatcgatttctttgccaaacgcatcaaagtccatattatgacatcttagatagctctccacacatatttgtggttctaaagaataggacataaacattcctggggataagataactctcagtcctgaggaaaccgtatctcaaaaggctctttgaaaggctttgtctaaataacacaaaacagaacatttggcagaaatgaagcccagacaaatggtcatgggtcttaaggatcaaactatttttgtttttatttgctgggagagtagtattctgagaagccttttggcttacttgttcttgagttctgtgtatgctctacattcctcttatgcacgtagaacagggagaagcaatctatggcatgtgagctgattttaactatgctggcttctactgccatgacctaccacaactgcagtaactgctgcccaatattccaagtattccatgagaccaggtatgatgactcattccctaaacccactcctacccttcaaagagtcagtccttaaccaaacaaccctcttctattccctccccaacttccctagaagcagatctgggcctgccatattgaaaacatggatgaccaatggttggatgaaagcacagtcttcaggtcccttctcctatgatgcccacttttaataacatacttccttacaaaggtggcacctggcagatgaatgaaagatgctccaaggataacctaaattggacttcattctgaaaatttgaaagacaatgacaagattcagcaagtatcttgccttatcattcaagaataccaactttatgtcaagaagcttagacccagcaggctggagtgtcatatgttgagttgccctggaatagaatctttgtgattgatgacaactgcaatctcacattcacccatgtgtggtttaactgaattttgtgcaccgtagacagttttgtttctgtcatttgcccccaggggactctgaggaccttgatggtcttgctggcctggaatgcctcaattctccatggatttataaaatcccagagaatgtactgtgcagactcagggtgaacatagacacaagcatttaatttcctttactggtcatcaaccttttcagctcaggatcggggggaacaccagccagaatactgaacctatttgaccattttcctatgctttttaaatttaatttaatttttatttatttttattttttaaaggcagagcaactcagggtcttttaaacaatgaggtcttaaattgttttaaaaagaaaatagtcttggattcttggatccatctgtagtgcgtattataatcaactgatgttaccagatcttcggtggggaacagagaagtggtagaaactggggaggtggtggttgcacagtcatccattttaaaggtcttccttaaatacctattgctgtagataggtaaatctggtcaatatcaggaaatagtattccctgtatttggtcaatgaaacatcactcactgcttgaccagattgcattccacaagacactagtagtagccatcatttttgagagtctaagacgggagttataggtttggtgtggattaactcaatcttcatgacattttaatgaggcacgtttaattcttatccctgttttaaatatggggaattggagattcagagaagccccataacttgcctaagaccacatagctagaagttaacgaagctgcaaggagagctcagactcacctgtatccagagttctctctcagctattctatgatcctgtctcctgatgaaataaacaggcaaaccaaatacgatgtgtggtggacataagaggagacttgtaacagaattaaagataagtgctcagaaggataaaaccagggtgattgctgcaatatctattccttatgaaaatattccatttgcttcctgttgaaacagactaacaagggataggttgaaagcaaatataagtaagcagatacttcatctttctgatctgtgcaaaacccatcccaagtgggcagtgcaaatccatgctgctcttcctttctcctcttcagcgaattagcacatcgaaggacctctctgtcctccttatatttgcaaagctacatgaactcattcttttcctctaggactgttggtcacaggtacattcagttcagactttttaccctcctttccttgctgccttccttctcaaaatcagcctcattggtagtttgcaagcaagtgtctagttaaaacaaaacctttccaaagggaagaagagtaggttttgctctgctgttttgatttctaaatgtaagggtggcgaaccagattcacctctggtgtttcattgtggattccacaattcatcacgctcttggcaagtggtggtgctccacatggtggggagcacgggggagggatctcaaggattttaggcagtgggcggtgttgaggaaatatcttcctaccctttccaccctcttgcttgtgtcgactatattttcgagtttcactcaatgatggagttgtttcttagcgtcttgtgcgcttagccatttaattaaagcaatccatattgaattcatgtccagatgcctcgaccggcggagccagatcctcattggcatgccagctgctccaagaggaacacggccccttgcatactaatcaggagaggaggcagtgattcatcagcccatgatactgctccagcatctacaagcacttatgacatgtaattggtggtgcataagcaagccaggccacattaaaaaccctacagatagtcagagataaaaattaatgacttttgctttgtgtaatcctgcatgcattggtgggaaagcggagaaggggggagttgggattaatgggcaaatctaagtaggcaccaaggaacaaaggccttcccggccttgtttacatatcgaacaataaaaaacacaagtgacaagttatgggaaaggcgagtgtgaattttcggcacgagtgagttgaaagactgcttgcagtttattacagattctaaatttccatattcattattccaaaacaaacgtcctcagtgggctcttctgggactggctagagcagttgttattattcatctttcacaggggctgggttgtcatgattagggctgggctgggctcactcttcatggcatgccccagctactcagggacacaatgcagacctttgacaagcccagaggaatgtgacagggatcaagtagagtcagtatgagcaggcgctccaacagcagaaggagcctcacacttagagcaggatgggggaagagaggagagagttttgagccacctactgctagacaagggaaatagcccaggtggcccaggtagtagctaatgaccaggaaggaaaggaagaaaggaaagtaggagtggcaaataaagtggatttcataattaatctgggcaggttaatgaatatagttattgggatggtatcagtcaggttctggttaatatggatattaaaaaggggattgattacacgtgtggtttagggtagtttcagattgtgttagaggatcatgcaaagtgaaggcaacaattcatgcatgtgctgcaagacagtcttttgcactgagtgccacatggggaatgcaataggggcaaacgtcaggattttgtagtcagaaactgcattggttgtttatttaagggccttctttaagacacagatggcctggctgaactttgaagtgggcttgagcaagaaaaagcttctaggctgatgggtggatgtggatatgttcagctactgtgatcactgaacaagggagaggcaagggcatgttgatgctgagattgaggggaggatgggtcattatcaaatatttatgattgtggtttggtggaggcagggaggtaattaaaagacagatactaagataataggcttaagacatgatgattttcccagtggtctggctttgtcctttctgaaaggaagagtaacatcaaccctatactcattggtggctttcttcctttctctccatgatggccttgttctgatgatccttatgcttctagtgttcttgttggtcatggactagcttagtgatcctcaggggaaaatctgtgggcagctgtgttagtccattctcacactgctatgaaaaaatacccaagactgggtaatttataaaggaaagaggtttaattgactcacagttccacatggctagggaggcctcagaaaacttacaatcatggtggaaggggaagcaaacacacccttcttcacatggtggcaggagagacaagtgcagagtgaagcggggaaagccccgtataaaaccatcagatctcgtgagaactcactatcatgagaacagcatggaggaaccgcccccataatctaatcacctcccatgacgtccctcccatgacatgtgggaattatgggaactacaattcaagatgagatttgggtaggggcacagccaaaccatatcagcagcatttgtagaaagggcatcctgagagtagaaaatgtccaaagagatgattggcaagaatgtgttaactattcctcaatgtgacaagagccatgctttgagttgagacatccctggtcttatgcctagagtcctttgttcttctgttgccacagaacaaaaccatgctatctggtctgtgcagagagtacatccacaattgtgctttcctaagtgtcatgatttacccatgagatgcagttaagaggagtaactcattcgcagtggtgagaatgcctagaattcttggtactttctgtagaagatcatgagctgttgatatagtatactaaaataacacatttgtacgccagttctgctacattcccagggacctggaacttgagtcttatgcagagaatatgtcaacatttaaaaacaatagaggggttggattttaagagatgacatttctcttcaataacttatatctgggggttagaaaaagacgtgccacgagtaaagctttcatctgccgtagtatccttgttctaaaagaggacagctagcatcacacaggaagagttgggaaatcagtggttaaaagtcctataccacacacccaaagaaaaacaaggcagaagaaaaaaagaagatctcttgagattctcttacccatgttcaactccatgccttatgctaagtggcttcagacaacgtggcttttatagagcctgatccaacaaagtaatattgattctctctttttcaaggttccttctcaaggaagggctggctgggacacatttccagtatcctgaaaaagttgactacataataaaaccagatgatgataaaaacgaaatttggggaaaactggagctattaaacaagtaggaagtcattgagaaacagagattacacactgggagaaaaaaatttatataacgaagctctatatctactagagagaaaaagaaaagaacctaacctgtgtttgtgagtgattaaatcatttacatgacagtgtaggggcctgagctgccctttcctcctgcaaggatgtcaggatgcccaacttggccatgtccactagctgcacatgtttctgagcacctggagttacagagggttatacatcttcccagcagcacaggtctctggctgaactaccacccagaggaaaacttactttctttttgcctcttttaatttcctttagcaaataaagtcctctcaagattttcatctagtcaggagaagaaactaaatcctttgctggcatgtaagaatattaactgtatcggatatgggaagaccactggaccagcaaaaacttatgtggacctgggactaattcaaaccacgaacaaaagtgatgaggcaatggcatgaataaatacgtagtgatctctttccatgaagagctcacagagccctcaaggtagtcaatgaacgtactccatgcaacaagagtggtggcaagagtttgtacagtttccaagagagaaactgagacatagtgaagactagtgattttctagaggccaaattagcaacaaacctagaaatctatggttgctctcttgtacttccctctttcctttcttttttccttcatttctttcctctttccttcctttatggcttccctccctccttattccttcccttgctccttccatctctctgtcttcccccttacatttacttactacacagttttaggagacaaagattttagatagatagatacatagacatgtaaatacataaatagttacatagatacatagtagatagacacatacatggatacatagacacatggatagttacatagatagacacatagatggatagacacatagacacacagatacataaatagaaagataaatatatagatacccagacacagatagaaaaatacagttacatagatagacacgtagtagacagacacataaatacatagatatatagacacaagatacatagacacatagatggatagatacatagacacataatagacagaaagatacatacatacatagacacacagaaagatacatagatagacacataaataggtagatacacagatacatagacacatagataaacagacagaaagaaagcaagaaagcaagcaagcaggcaagcaagccagtcagccagcccaggctagtggtgtcttgattataatcttgttgaagagctattcagttgatggtggggtataggatgagttgacaagggacaataacgagggtggatgtgtggggtagtcagaaagcatttggattttctaggggtaacaagggctctatactaggcataaccagcaaaagaactggaaaaggagaaggcagatgtgagatctgcttcaaacagaaacactgagatttggcaacaaatcagatgtgggatgaggtcaaaggaagttttcaccccaagagaccaaaaaaaaaaaaaaaaaaaaaaaaaaggtggtcccttcacaagacagaaggtacacaagaggagcaggttaaggaccacagctgacttccaccttgtatccggcacgctgaacatcctgctgccaatgcaggtggaagtgttgagctggtgcagtctcaggtaagtctagtctgggatgctggtttgagaatgggtgatgcacccactcacgaaggagggagaatgtccaggatgcaatcagacagagaagaggatggggtcaaggacatggcttatgtgctgaaagaggaaggagaaaggggacaggaaggtctgccccaaaggcagcagggccaggagaatggagtcgccacggccagaggaggacagcgttctaggaaagcagagggggccacggagggtcaccagcttcatcgctgcctctctgctgagaataagccacacgggctgagcagggagaagaggctgttgaatttgctgatccgtgggagggccattttcacggaggtaggcaagaggacagactgcagggggttaaggaggaaggggatgtcaagggcatgaaggcagtgagagctgaaaactcattaactgccctaaatgctgaggacaaatagaataataaacttctaggcaagaatgaaatgcacttttgcctccaggagaccacttcagctcttggagctgaaggaagtggggctctgtgccttcccctgctgtcaacttcctgtccgctgcagcccccgaggttggcagaggggccattgttctgcccgctccccaaaggaccgtcagccgagtggccactcgcagtcactcttctttgtgcctggagagattagaaacgaagaacggaagctcaagaggctccaagacagacgctcggggcaagtggaagcgtttcagagtccccaaatttgaacctgtcccctcctcctctcagtcctgtgatcttccattaaattggataaggagatctcttttcctccttttctttctcattcttttttttttttttttttttttttttgcaaaatgaatgctttctgaatctgcttgacgtaagaactttctttgttccaccctaatgttgatggcttgttttgttcttgagtttgcctgctttgcacaaagggggaaaaatgtcctcaaaactaaactgaattcagcagctctattcatggccaaatttaaaacatttaaaggtaaattcaattagcaaatgtagaaccaattattaggtgaccaaacacagttttcaacatccaaaatgtgagtctttttcagaaaaaccaagacatacataaagagtttcattctcctaggctaagaagatacattttagtacgaaaagggtgccaaactgttgaagtgatagctataataatatttaccaagtgttacgtgctaggccctgggtttttcctcagaaaacaaagaaatcaaacaaatgaagacaggtttattttccctatgacttcgatttttccagaaattttacaattctgaattaaacaaacactggagtgaattagaacctaaaagataaaaagtgattttaaagaacccaacaactgagtaaaggacttatcttttaccccgtgtaactttgctgaatatatccagtatttccaggagtaaagtttccgctgcagaatatttttctcctttgatatatttaaggcactgatgtaaccatccacggctttatagttaaagccatcaaaacaaactcagatacaactctgacagctatttctactgttcgttgccaatgaagattcatgatcagggtatcagtcacctttgtttgggctaaatttcatgtacgtaataataacgtccctgaatgtccccaaggtcctgccatttgattctcccaataactagattcaacatcatgagcttttgtgatttgaattgaaaggggctggaagttgacagtgggggaaggcacagagtcccactgccttcagctctgagagcagaaatggtctcctggaagcaaaactgcatttcattcttgcctagaagtttattattctatttgtcctcagcagtttgggcagttaatgagtttttgactctcactgccttcatgccctcaccgtgtcttgaaatgtctaggccacatttctacaaacagcacatcacagattctttttcttctagttcaatgcccagttctgcctctagccattcgcagcagtgcacgtgttctaagttgtgttaacagctggagatggatctttactgctccacacccaggctcccattcgttctggggtgtccacctgtgtgtatctggggcggcaggtgcaggcagtggaaggtggtggagagggagggaactaaccctattattaacctgcgaagcaccagggactgtgcaaaggcactgggtgttaattatctcattgaatcttcttatatttttaacttttattttagtttcaggggtacatgtgcaggtctgttatatgggtaaatgctgtgtcacgggggtttggtgtacagggtaatccatcacccggacaataagcatagcacctgatagttttttggtccttaccctcctcccaccccccaccctcagggaggcccctgtgtctattgttcccttctttgtgtcattgtgtattcaatgtttggctcccatttacaagtgaaaacatgtggtgtttgattttctgttcctgcattagtttgcttaggataatggcctctagctccatccatgttgctgcaaaagacatgatcttgttcatttttatgactgtgtagtagttcatggtgtatacgtgccatattttctttatctagtctaccactgatgggcctctaggttgattccatgtctttgctatgtgaatagttccgcgatgaatatacgtgcacatgtgtctttagggtacaatcattgaagcctcttaacaattctgggttcaaacctttcatccactaaagcagaatctgttctctgccgtctttgcaaccgcatcccctgtactctcaagggtcatcaacccttagccaagtttaaaacaatcacaatttcaaatttccttctcatgatcccgtccctcgcttccccaaacctctaccatttacctataagagcaccctgtcgagccttaatatcaccctcagaaagatttaaggcagacctacaaggttccctggactcctggtctgaccaccacttcttaccaccactacctgccaaagggacctcccaaaagtgaggcataatttacaactttcccctaaaagaccattagactcaatatcatcatatttcaaaatccccatttatttccatttacctgttagtcccaggctttcaatcatccatatgttcccagatgcttatccttcatggctgtgtgctcctaatctgacccaaccttccatccattcctaacctcccaaatccttatcctacgtcctgtgggactcctgttctgtcatcaccaaaactccctctccctgaacctcccctctacacgttctggcgactgttttgccccagtattctctggaggccactgctttctctgaggccccttcagtggtgagctttgttacttccacatcccaaataccatagtgccaggaagtgggtggatgtcttcatcacctcccgttactgcttccaggctactgttctccaaagcctcctttgaggcacatcccatcacactgtgcactgaatcctcctcctcatcgcagccattgatcaccttgcatagcacatctgctgactcatggaatcttttaatgcctgactcaccgtctttgtctccatccctgcttgccattactcttgatgacttcagtatccatagacaatccatcaaatgtgctggcctctctgctgcttgacttgctcacttctcatgaccctttttcctaccctttctaggtccccactgtactggtcacaccctggaccttgtcatcaccagcaacgtcatcacttctaaaatgctcttttagaagcatccctctctttttaaactttctatcttcccagcttactctttctagttttccaatttcaataagtcttcatcttcccttggcgggggggggggtcctcatcccctttttatgcccatcctctgcctcatgttttgcttccgttcttacacagtttagattccagggttcataactaaaactaaaactcgtgcatactctcagcctccttgatcatcaaaaccctaagttgctcaatcaaaaccctaactgatcttgctcatcaaaaccctacgtctgataaactaatttgtttcctaatctgcagatgagcatcagaacgtgctgaagaaaaccgcacagccaggctgcctgacctcactttaaatgtatgaccacaagtgtcacgtggaccctcagccctgcctagcaatccccaccacaccatgctaggcagcccctaaggagtcttgtcacccactgtctcccctgtctccagcccaccacacacactactgacagttttatccctttgaaacatgactgtgttctcagagcttccccaaccgggaggctgggcacatcgtagggccttggcaaatatttgatatgtaagtaattaaatgaatcacactaaataaaggtcaactttttttttcattttaacagtcaaaatcctctgcagcttggttcagccacatctcctatatggggcctcttaaccccttcaaattagtctatcagttctatcaggtctacaaacagactacagtatcccgaaatatgatcgattcgatggaatcatgcaaacttgccaatatatgactgctctgacctacaaaacagcaatttcacatgcacccccacccctgccaatatatgtttctgcctctctgattttgcttaagccattttaaatgccagattatctttctgggtgatatagtttggatgtgtgtccctgctcaaatctcatgctgaaatgtaatccccagtgttataggaggggcctggtggagatgagtgactcatggggcggatttctcatgaatggtttagcaccatccgcttggtgctgtcctcgccatagtggatgagttcttgcaagatctgatcgtttaaaaaatgtgtggcacctacccccttgctctcttcctcctgccttcgccacgtgatgtgtctgtttcccttggccttccaccatcattgtaaacttccagaagcctcctcagaagcagatcccagtgctatgcttcatgtacagcctgcagaactgtgagccaattaaacttcttttcttttaaactacccagtctcaggtatttctttatagcaatgtgagaatggaccaatacacttcaggccatccaacttgggcttcagaatctgattttaagtctcatctcttccaaagaggctctgaatgtagagcttttctcctgccctcccaaagcactgtgcaactttttcttcttcacctgctctcctctgccttgtaatgaagttgtttgtgcctatctctcttctctcattatctcctccagttgtgagtgaactccttgaagacaccatcttgtcttattcatctttgagtccctcacaggttctattacgaagctctacacagaggagctgctcaacaggtatttgttaaatgaactcaaatagtggttaattgttccaagcatgtaaccttatattctatcatctaacagtgggagaaataggtgtataaagtctatttcgtctttttgttccacaacaattttaaagtactaatatatttttctattagacgttttgccacctcaccaatagtaggagagaaaattcactgggctgggagcgggttgcttattcaaccattgagataagccaactaatcaaccatgaagagtaggaggcctatggtaatatttatcctggcaggatgttctcctggtcatttccagacatgaactgacatacaagggcttaggactttggatattccacaaataaagcatttctttggggcatcagcggctccttcatttggtctaaacaataggtgaaagaaaggtagcagctgatgcttcagctgctgacgatgatgacaaaaacgataatggcatttatatgattcagcagtgctcgacaaacccagcaaattacttgtaaagttggcagtcagggctgtcaatgagagagtcacctttgggccagaaagcagcagccacatttgcataaaaagagagagctcctagcacctgacagctcagagggaggtgagcaagtagaactctgggatcagggagactcacggaggtaacaggcttacgttgcagtagggaagactgatgctcagaaacaaggaagaacttccggagaactagggtcttagcagaggaagaggtgctcagaggaggttattgaacttgctcataagagttaaagcagcatggtgttggtgcctgaataaacagaccactggaatagagcagacagtctgggaatacagccaagtgtatatgaaaatttaggacataataaaggtggcactggcagtcactggggtgcagatgatcttatttatttatttacttattcagaaacaggtcttgctctgtcacccaggctggagtgcagtggcacgatgatcatggctcaccgcagccttgctgggctcaagcaatcctcccacctcagcctcctgagtagctgggattataggtgcatgccatcacgtccagctactttggtttttttgtgtgtgtgttttttgattttgtagagacgaagtctcaccatgttgcctaggctggccttgaactcctgggcacaagtaacactctcacttcggcctcctaaagtgctgggattataggcgtgagccaccgtgcctggctgatctttttacttggtggtgctaggacgactggctagacagttttttgatatagttagtaaagttagttctatccctccaaccacaaaaaagactgtcttccaaagtggatcaaagagctacatgaataaatgaaccctacaagtactggaaaaaaacatgggtgaattcttgggtgtgaagaaatgacttctaacttgagtcaatatccacagtcaatagaagattgataaatttgattatataacatttaaaaaattgcatgaaaaaaacatcataagcaaaatcaaaagatgcgtgacaaacaggagaaaactgtttgcaatttgtatcaccggccaaaggctaatttctgaaatatacaaagtcttcttaaaaattgagggagccggatgcggtggctcacacttgtaatcccagcactttgggaggccgaggtgggtggatcatgaggtcaggagttcaagactagcctggccaacatggtaaaacccagtctctactaaaaatacaaaaattagccgggtgtgatggcaggcacctgtaatcccagctactgaggaggctgaggcaggagaattgtttgagcctgggaggcagaggttgcagtgagctgaggtcgcaacactgtactccagcctgcgtgacagagcaagactccatctcaaaataataataataacaatagagaggaaaaggccaataaaaaatggatgaaggatgtgaacagatgattccaaaaaagatacataagtagcctttaaacataagaaaaaaatgttcaacttcatacataataagtgaaatgccagtgaaactacattaaaacagtttgatggttcctcaaacgattactcacagagttgccatatgacccagaaattctactcctagatgtacacacccaggagaaatgaaaacatctgtccacacacaacatatatgaatgcttggaattgcattattcgtaatagactaatggtggaaacaacttaaatagataacagataaatggataaattccacagataaatggataaacaagagatggtatatatacacaatggaatactattgggtcataaaaaggaatggagtactgatatataccataatctagataaggcttaaaaatataatgctcaagtaaagaagcaagtcacaaaaggctacatattgtataagtccatttatacaaagtgtcttaaatagccaaatctatagacagaaaatggatttatggttgcctcgggctgggggttatgggacattaggagagtgagaggtaaatagtactaggtttctaaaatcggctgtggtgatggttgcagatatatgtgaatatactataattcactcaattgtgcactgtaaaatgggtgaattgtatggtacatgaattatatctacataaagtggtttttgaaaaactaccttgaaatattatttctcacctattagactcataaatattagaaagcttgatacattctgctggtgaggctagggggaaacaggccttttcataacttgttagagggaatgcaaatcggtacaatagttaaggatggggtctttgcaaaagctaacaaaactacgtatttgtacacctagtgacccaggaatgtcacgtttaggaattcacctaggtaatttatcctgaagacacctgtccaacaatataatacatattcacatggctacatactgaagcatggttcacaatggagatattggaaacaatctcaatggccacgaatagaagactggttggataaacgatggtgcaatcagacagtgcggtactattcggctggagaagaatgaggaagagctccaggagtcgatgaggaatgatttccaggatgtgttgagggaagaaaacgggtgcaaaagatcatttctagtattctctattttttataagaaagaagaggaaataaactatacaagtatctacctattttaacaaaaggaaacattgggaagaaaatcagaaatggaagagattggtttcctgcaagaggtgggtaggtacaggtgggagggctaggaaggaaagtggcacttctctgaatttgcctttttacttaattttgacttttatgatcatgctaatgttttatatatgcaaaaaatccacagggatggggagaacacccctaatagaaacaaatgaaccaaaaagtatttcaaatgagcaacacagtgacactgtgtgggggctggggaactggcccaagtgaccttccaacagagagttctgaccaggtaccctcagtctaaatactaaacaaaatattgaagtctagttagcaggtatgtttttcacagtgctatgcatgaacaattccaaaacaacttcctatgtatctcaggattgaacaaatgaatgaatatattgagaaacatgagagctaggtatctagtttcttttagtgaagacatgtttttttctttttcttttttttcccctaaatatacaggaaggggaaagctaaaatgttgtaggactgaaatggaaagtatcagtatgtttcatatatatgtgtgtgtgtatgtatgcatatatacattctgtccattaaaagagtcttgaattaatgatatcccagtagccctgatgctcagatctttcaaattctcttcttcaccaaaagaatccaggactctttggagagatggctgaattccagctcaggtaagttatagctgatcctgaacatcttgctccataaaacaagaaagtgctcaaagcatgaagaggaggccacatgcggtggctcacacctgtaatctcagctctttgggaggccgaggtgggaggaatgcttgatcccaggagtttgagaccagtctgggcaacatggcaagaccccatctctctaaaacatttaagaagttagctgggcatgatggtgcctatctgtaatcttggctactcaggaagctgaagtgggaagaatgcttgagcccaggagttaacgtgagccatgataatgccactgcactccagcctgggcaacagagtgagatcccatctctaaagcaacaacaacaagacatgtgaaaagaacagaaagggctcctgttgtccaactctgggacaatttgggtatcaaaataaatcatgatggtaatggattacaatcccttgaataatccatcagaatccatgaattcctactaatataaatggatgcataaatatatcattaatggagagaagggaaagttctttcttgcagtagaatttgactcataaatgtgaaatgatggaattagaaaatcactgggcaaacatcacagtaataactggttcaaataagaagtgcccatggatgctaaaactagtaggtgaatgtttgatgaagatcaggatatttatgtcacttcaaaatatctctccacaatttcttattagttgcaaatggaaaaatagcaaccttataatggagaaacctggcacatagcacctcagccaagtcattaaagataacatcacaaataatggcactgacccaaaatcatatcctctgacttcctcactgaggaagacacagcatcacttctggggtgtttctgccaaaaattcatcacctagatctaatcataaggaaacatcagacaaacccaaattgagtaaccttctacaaaataaatggtctgtactcttcaaaaatgtcaaggttaaagaaagcaaaagaatgggtgaagataaagaatgaggaattgttctggtttgaaagaaactagagagatgtgacaacgaaaggcaatatgtgtttccggataaagcacattcttggaaggatggaaaaaatttgaatttggactgtggattcattgatggtattgtataaatgttcaattttctgatttagataattgtactgtgattaggtaaaacaatgttcttgttcttaggaaacatacaccaacatgtttagggataaggaagcacaaagccagcaatttattctcaaatgactgagaaaaattatatatctacagagagagacagagagagagagagagacagacagactgacagggagacagggacatggggaagaggagaaaaggcatgaatggtaagggaatgggacaaaatgtaaactgctggggaagctcgatgaagagtatgtcagtaatttttctactagctgctttttgtaactttgacaataaaaatgaaaagtcaagaaagcattgctcacagatctttgagagtgggcaactgctacatctcagttttgacacctgcttgtgaatctggggagctgcagagagaacctgggtcccttgggcctttgtttttcaagctgcaccaacttgccctgtatcccttgtcctgttcatggaacttctcagccttactcagcttaaaggggttgaatgtgaatggtttggagcaaaatcttttcctagttaaaagcattttttttcatagccctggatttaaatctttttatacggaaatattatccaattagacacagctattttcttttattttcagacaataaaaagtcttattttgttatttctttttaaaattaatttgagtttttaagttccagggaacatgtgcaggatgtgcaggtttgttacataggtaaacgtgtgtcatggtggtttggggcacctaccaacccatcacctaggtattaagcccagcatgcatcagttatttttcctgatgctctccctccccccaccccaccccccgacaggccccagtatgtgttgttcccctccctgcgtacatgtgttctcactcttcagctcctacttataagttagaacatgcagtgtttctttttctgttcctgcgttagtttgctgaggataatggcttccagctccatccatgtccctgcgaggacatgatctcgttcctttttatggctgcatcatattccatggtgtatatgtaccacattttctttatccgctttatcactgatgggcatttgggttgattccatgtcttggatattgtgagtagtgctgcaatgaacatacagttgcatgtatctctgtaacagaatgacttatattcctttgggtatatacacccagtaatgggatggctgagacccagctattttcaatatgacgttgatctgtgagtgagaagtcctcttctcacctgtggtgcttggtggtgctcggtgacaccagcccagggccctgcttccctagggcacagatgggtccctgactcagctgtggccagaatttagaacatgttggttctgggttgtgaaactaagccataaagacgctgggattctctaccttctgggctatgtattattccttggggagggctcccaggccagaatgagggagctgtccctctgagacccttctcatccttgggttatttcccccaaggctcagcgaccctgcaccttttgatcagcccctctcctggctgtgagtgttgagagacccccagtcaaatcgtccccaactcaatatcacattcagatgcccagacaaagtgtgatgatccaatggatacatcctctgcctgccttttggaacttttccagcatttgggaaacatctgtccctcccagaccactgaaagcttgtctttgaaagcctcacgcacctggaacactctgggctctcccaccgtctgtcctctcgccaccatggatgcacagggccccctttgtctgggcaggcagcatctccccactcagcccagccctgtgatacccaaggtgaagaagaatcacagattggccaaaacagctatggaatgggtcaccccaagttgtcatgcactttatttacttatacaaagttttgctttgtcatccaggctggagtgcagaggtgcgatctcggctcactgcaacctccacctccccggttcaagcgattcttatgcctcagccactggagtagctgggactacaggtgtatgccactatgcctggctaatttttgtattttttgtagagatggggtttcatcatgttggccaagctggtctcaaactcctaacctcaactgatctgcccacctcggcctcccaaagtgctgggattacaggcgtgagccactgtgcccagtctgtcatgctctttggacactgagaatggggaccacagacctagccaaagagacctgtgacctaaagaggccaaggaagaggagacttctctcctccctaaaccatgaagttaactatttaccactgttgtaattatccttattatttcacttaagaatgataatgatgattccaattaatcttcatgttcactataaggaggtatggtcattcctgtgttacaaggggaggaaattgaagctcagagccataaaataaccagcaaggatcctggaactgctaggtgcctgaacccagattcaaatctaggtctctgtgatgccagagccatatagaagacacacaaataaatatttgctccttcaaatgactgcaaagtctatgtttacacagttaagtccccaattcatgtcatcccaaacaaacttcttccatctgattctacttcctgacacagcagggcccacaatcacaaccattccttttactgggagtatcctcagcccggagggaattgctaccttttcttagctccattgctgtctgctctccaggcctggatgccccgtaacaggtattcctgcagcccacaatggtgtccagctttgttgggatacccagtcgtggaaacacactttgtgatatcagcatctgttccatctggggcatcagggactcagcctgttcctcacccataacctccttgcccagtgggtgtctctgcaccgtcctcacccttctcagaggtagatagcagcaaccaggagcagggaggctcagtgagagagaaagtcattggtattggcaggtggctgaggcttgacttggagctatcagctgtgtttaagcatgactgctatggtaacacatttgcgctgagaactacactctctatttgtctgttacagtagttaatttcatctgttttgcagaaatatttactaagggtgagtgatggaggcaggcagctgtggctgcatccactgtaaccatatggtttatttacaaccagagctccatggtgcagatagctcaaagaggattaaattatactttgtagattaaagtcctgaacactataaaactcataagcctttgtatgctaagcaagaactttgattcccattggacatgaagctgatattttgcacacacagaaagagtgaaaacttttgatatttaagtattttcttaaaaagctggcagaatatcaagcttgttccttaggcagttgactggttaaaggggaaaaaagcagcttcacaaataccttttaaaggaactgtgtgacctgcttcattctcactataaacaaggcctctccatctctgtttactaatcttcttgaacttgggcaggccgactgcttaaaaggaaactgcctccaaccagccaaagccacggtttatttttctgctggccaccaagacatactccatgtaattacatccgaagcactcggcttctccaagtttacttaacattggtgagaaaataagtcctaaggaaaagcctagcattgttggaatcttccatgcaactgggagcagctccgttaagtctccctgcgatgggttgttaatcacctctctggcaagggtccttcacctttggggtgggtcatttgtcctcctcccagccccccaaccccagcctccatcctcttcagaccctgaaagaattccgttcaatatagccttctcattcatctttaaagtttcactctctgtcaccttccacttgaagccgtgtttgatgtttccacgggcgtttctactgatgggcttcacccggagagctttgtcgttgactttgagactctggcgttcagaggatggactgatcttcgcaggtgttattttctgcacacggtgcaattagccacacaagcccaattggcacaagcaacacactcacacgttctttgcactgaacccttggtgctcatttgggaggctcttgtgggacccacattcccggttaaagacgggaaagttccttgtggatgaccaaccctcaccaagataggtgtagaggcaaattcagcctgccagaagcccagggacttctcattcattggaggcaagtcttatgtgcctatgtagggaatcagataccgtcttgtggcatttcagtaccttggttcggtggaaaatcaatgacttcattaaaacacagtgggaaaatatacttttaaaagaatttggagcaagaatggggatggttttattatcctgggggtccacaggaacttgtgtgtctcagccttcttttgggggcatcaattaataacagatcaaaacagaacagattcccaaggagtatttttcacactttcccactcagggatctcccgagggatctcttgtgtcttcctgctacctctagacttttgttctgccacagcaaaggtatcaaacatcttaaaatctggaaaggaggccgggcaaaggcttggaaggcaacaatccccgggaattcccccagctgcttgtcacacaccatcctcacacccttcccctggagtcacactgcaaccctgacacctagttggagattgatcacctgatcagaagaattacctctaaccaagtgcacagtcagcagcctcatgcaggatttgtgagatcccatacagtgtttagtgtgctctcgtaggaggtgttagtagcagttgtgtgaataaaaggtgattgtaactgtacctttcattggggtgatcttgtttaattttcacaatcatttcaagagataaggagtacagatgttatcagtttttgtaagtgaggaagcttgggtagagagcttgtctatcgctttacctctctctctcccttacttcctccctcccttcctccctccctccctccctccctctctccctccttccctctctccctccttccctctctccctctcccttccttccctccctccctccctccttccctctctccctctcccttccttccctccctccctccctccttcctccctcttttttccctctcttccttccttgttccctcttccctccctccctccttccctccctttctcccttccttccttcttccctccctctcttcctttcttccccctcctctcttctttactccccttcttcttccctcccttcccctcctttttcctttcctctccttttcccccctttccatggatccttgagaactcaggcctgatacccatggcttttgcctttccagttctttattctggaataaagaactggcaaggcagaagcctttttccttgtgtagggaaagtcacctttctccacacagagaaatctgccttcttttaagcaaaacagtttgagggaggatgctgagtcttcatcagcctagattccaattataatggacctatagcaagctgcactgaaatcacatctgatttattcaaccccttttccctgatgattaccttctccattctgaacaagaatatctcctctttctgggtgagggagcagcctgatgatagcctcattagaaaatgcggccgctccttcttgcagtctaattggctgacagggtttgggatgtgaaatgtaaattgctgacagtgtgcacggccctacttttatcacagtgaaatcttcagctgtcaaagcaaatggatatgtggagtggttcattttatgtgtcattaaaagacccataattccggccatacgtctttcctggattctttcaagaggtggtacttgggattccctggactcctgagtgtctcctggacaccctacacaacttcaggcatggtgaaggcagctgttgcagcttcaggtagcgaagactcaactgagagagttggccctatgtgggatttctcgggcttctcatataggcttatgtttcactcatcacttctcctgcatcctgacccttcggtcaagtgctggaatgttccagaagatgagatggttggctgctgtttatggtcctggtggctagaggcattgctactcaagggacactggctggtgagcagctttgagagtctgcaagccaaagacggtctcttgggagaaatctctttgtagggaagcagcatgtgcgcaaggaagtctgggcaatcccagagcctgagttctgcttcctggaaagtgtatcacaagctcctcaagggaggatgtgggccagctcatcgggatccaaacccatgcaccggtccaaccagtgacttgaaaaatggaggtgtcagcatccgatgaccttccccgcataagaaagggaagtgacactggtggcatttggcgttaactgtccaagaatacgtaaggatggcaagttaaacagtaatcaccaggtaaccatctcagacagatagaaacagaggggaaaaaacccaagagtagctatctttaaagagaacaagcagatctgagtaatccaatttaggagagataagagcctgctgctagtactgtcctttaactggacaaacgccttcgttcaagtgtcaaccccaatccgggagaggtcaccgcactgggcctgctgcctaatatactcctgaattggctgagtggctttccgaacaaacacactggtccaacagaattgattttcaacaggccgtattggtccctaacgtaattatccagcagtgagtcagttcacggcggcccctgcatttaaacgctgctggtcagcctgggagaggggacagctgtgcagaggggccttctccaaacttcacttgggaacctgtttctttccccccagctgcttttctcccagcttcctaaataatttaaagagcgatggggattttgcacagctccgtcttaagtgggcattgtcttagaggccttggtctcatgtgccaatgaatatcaagtcctggctgtttgataggtgaattcaatttaagataaggaatcaaatggaatccttttaaaacgcttcaatgtttaacctcttcctttcttcaaagccttcttggcagcacggtttccattacctctgggtctccagccttccaggggggcaggtccatgggggtgacctcccagaatagtgccctcccccaaaagactgtcactcaaagcctctggtccaggtccttgtctgtcaaatgtagtatgacctttaaactttcagctgaacattacaaaagtatctaaatgtcaatgggttcccaaagctggtagatccattataaagggtatgagaacttttataccatttctaggatatccaaataaaataacttctccctggatgcaggaatagtggcaagcctcaaagaccacaatgttccttcccattcatcacttccattcagactgagagaaacttacatatttctttcagtctggggaatcgccatactggtactatcttttatacacagccttttagctcatgcctctcacccgcagagagggcaggagtgaggtctgaggcatccttgtcctcctgacacccagtgcactgcatggcctaaagcagtactcagcaacgctgtgtggagttgaattaaagtgatttttaatgacaaaaggacaatcaaatagctcggtaagcatgggcaatagcttgacctctctgtgcctggactgcatttcttcatctttgaaatgaggataacggctcctgtggcatgaggttgttataaggataaacggtgtcactatttgtcaagcctttggtttctctctctctctctctctttttttttttttttttttttttttttggagacagagtctgtcacccaggctggagggcaccaggcaagatcacgactcactgcaatctctgcctcccgggttcaggcaatcctcccatcccagtctctcgagcagctgggactacaggcatgtgccaccacgccaggttgatttaaaaaagttttttggggtagtgatgcggtcttgctatgttgcccaggcttcaatactcatcaagctgttggaactgcacctgggacacatagaagctttaagtaagggacacaactagccacttacagggtagtacaaggggtgtccaatagaaacagccttcctgaagcttttcttcatatgggacttcatctgctgtgaaatcctcagctgcactggtcaatcagccgtgctatccagcctggcctccctaaactggcttggttcagggctggggtcccaagcctgtgtgtgtgcctgaccagaagcctcatggtccaggggtagagagttgctgatgaggagatgtggagcaggacacgaagagatgtgtctctgcctgccccgccctagttccagggggaatccacacaggcagtgacaatgaatgaattcatggtggcagtgaccatgagagaaattgatcatctaagttctcaagaaacactgtgcattcatgattgacctgctgggaggctctgctcaggcaaatggtaagacacagttagaacccgtctgcaagagacaagaaaaatattcccatttgtttaaaaacactaaaatcacccatgggctcatttcgccaaagctgttttggttttcaccgagtccccctggccagagtggagctatgaaaaccaaagcaaggactgccatccatttactcactctgggttgacccaggatcctgcttggctcaagcgacctgactgaaatgagcacacactggatcatttctgaagcccaaactaacacaatagtgttattagcaataagattgataatgtgctggatactatttaagtgctcttcttctatcagttcacttaatctgacaggtaacatcactgtcatttcatctgaggaaacgaaggcacagagaggttaaagagcatggctgagatcacagatttgggactttgaaccagctcatggccacttagccatcctgcccctctgcagagaggaaagtagatggagatgctgcagtttacaaaatcacgtgaatgctgttagtatagacccagtgtgcggtgaaaaatgaaaggaagcaggagaaaaagaggcaggaggagaaaggaagaaagacatttggcataaagaacaggaggagataggaaaaagataaatacgttattaatacttaatattgttatttttatttatcaaataaatagtgttcatgataacgacaggtaacatttatggagagcataaaatacgccatgcgctgcattgtatgaagcacttcacattcagttatttaatattcataatgaagcaatcagttattactacaaatctcactcggagagaaggaaactgaggctcagagaggttataacttagtcagtatgggaccaaaatctaaccagagtagggctgtgggatttagcaaataaaaatacaggacacccagttcaatctgaattccaaagaaaccccagatcatctggcacgcacttacactaaaactaaaaatcatttaggacatccttatgctaaaaaaaatgtatccatttatctgaaattcaaactgaactggcatcttatatttcatctggcatccctagacagaggcattatgaggttgtctcaagtttttatagttttaagctggcaggaacttgaaatgtaaggtcccgagtgtattcatctgatcagattctcagtgcatctgtatagacgccaacaggatccaaattcttaactggctgcaaatccaaagttttaagtgcccgagtagaatctcaggcatgtacgatgactgcccagctctgtgctggggggcatgcccatatggggccctcatttcacgaggtctcccttccacgccctgttacctgcaggtaacatgcctgttaccagcatggcctctggaccacgtgcatttgacctcctccccagtccagcgtctgcctgcgtgcaagctctttctgccccaaacaggaggccaagaattttcccgctttcagtgtgcacagctgcctggcagccagagacagcgacctcatccacccttcttcctgcctgtccttcccctaaagtcctcctgaatagggtcaggttctggctgcgtttttcagtctctaattagcagattccaattcatcaccctgagtatctcccggcatcagccccaagattccctcctcttgcctggtgaatcggtcttcatttaaaaccctctctcttagccctaaatggaaatcaattctgcaagtttagcaaatagttaattactccacaaagaggattgattggcctttgatcaccagaaagctctgcagtgctattagtctctttcatctgtgattaaaccacagagagaaagaaacaaaaactaaattaggcttctcctgttatcctacaaatatttaatgacgggctaatctcctagaggtgtgttcgggggatacgtgttccattaggagccagcttccattcaaccttgaaccgagattccatctttgtggagagtgcagcaaagaactttacagaggaacagagctgggctcaaagaaacgctttgtaggacacactcttttctgccttttcttctcttctcttcttatgtatgttttaatgcagataaagattttcccagtggactcctgacatgaataataataataagaggaaacctggcttaaaaaattccatttgggtttttttctaactctgtaactagaaccagatcctgtccccttgatttgcacacaccaaggagttcctctctcaagccacagactccttcaactaggggcagaaaaggcaggtgccatggagctttttggtggctacctcttcctgaatagggacactaaagagcagggcaggagctgggatggtctgcttcatccaatcctcaacatcgtcatgtacaggaaatgactctttagaaaaggcactttctgtgatacaagagtcctataaaggacataaggaaactgaggcacagcagggaggacagatcaaggaccttggagtcaggcagaattgaattcaactgctccctctgcttaatatctgcgtgaccttgggcaagtcgcttcacatctcagactatgtacaaaggtgaccataacgcctactttccagggctgtgctgctgatctgttccaacagagcgcgacggtaccaagcatagggcttgacgcatagtaggagcatttgttgctaggtttgctcccctccctttcttttactcagggtcacacagctcattactgagagagttgagcctggagccattgtccttcccgagtccagggtttttcctcccccacattcacgctgcctctccagcaacctttccactgtacactttccattctgcttagaattcatcccagagacctaagtttccgaaataacatcaaggcttcagaattaaagaagagatccaggccaagaataatacagccaagaaaccaaccaggttttcgttgaatgggcactttctgaatggcggagtcaccccccgccgaccattgccaacccactggataagctacttcggtctccagaaacaaacacaagacaggacctaattgattgcttttcagcctggtacggctggcccgatgaagacagctggcatgcactttgtaacaccctcatttgttcttcctgcagtctcatgtacagccccacgggtcactctggggttttcctcttcataattttatcagaaaaaccctgctaattggattgacctagagcaagacggtgatgttggcaaagtcggtgctctgtaataccagttccagctttgtcttcaacttgtccccacgctgagacgggacccctcacggcggtgacacatgccttgttctacatgctaaagaccaatggactctgcaccagatcatccagtgggagtcccagctccgacacttacaagctgagcgaccttggacaatacaatggcaatgctaacaagtttaattaacatatgctgagcaccttcttgtgtcaaggacggagccagcatttccatggggattaagtagactaattacctgaaagtatttgtggctatcaatattatcattagattttgttcggtttcactcacgtcctttcaacattcatcctatacatgaaggctgtttgctgcaaacacctatgatgctcacctgagggcttttttttttttttcttcctggccatgggagtacactaggcctgtgctgggaggtgcccaagagctaacagggtgggaagcagccgttaaccagagactgactgggatttcctcctccctcgggtggacaactctgagtgtgtgccccataccacctcccaaagttacccagcagagctcagctccaattggccatggtggaaatgtgctagataatacacattttatggacttctttccttcccctctttccctttccccactcctctactagtgtttcaccttccaaatagatgatttctcaaatttttgtctctggttctatttctgggaaaacccagactaagagaatagatcttaataataataataataccccccaccacaaaaccccagcaagaatatttgttactcgactgaaaatttggggcataaaatgcatcagcaggtttgcatcttggaagaaggttaaaatgaaattaattacaaaaaataacaaaaattgagagagagagagaaaacaggaatatggagaagcaatggtaacgtcttctgggagcaaacaaacggtgacagaagtaacctagggcaactgagatggcaactaagaagagtacagggaaggccagagccttctagaattgagagagaggacagagacagagacagaaagaccctgttggaggcacactgggccctgttacagatgagctacttcaatgtcactgtggttttgccagaaaaccagagggcttaccctataggccccattcctccaggttctaaaaggagcctaaaatgacaggttccccttggaccagcagacagaggagtggtagggttcaggctgtacctggcaggaatttttagggcgtgagaatttgaaccgtggcctgtgtcgggaggtgtgtagtttgagtggattcctcttccgggtcactctgtcagactcctcacattccttcggctccatctggaattgcccatttccctcttccaggctggtctgctccaacccactttccatgcccacccactgctgtctaatatccttcagggacttcgcactgctctcaggagaaggaaaggtaccctgggcccacccagcaacgtctggatctctccctgtgagcctcccccatcccctctcgggagcatcttgctgctccgtgaatcagccctgctccttccagggcctcccaccatttcctccctctgcctggcttcccaggcctgggcatggagctgggctaactcttctgtatctgtcaagtgtcagcttaggagcttctttgagacgccttgctttgtacggatttgtgctaggcagctccggaaatggcccccagcaccgtccactccctggcatctgcactctcttgcagtcccctcccctcgagtgtgggctggacttagtgaaccacttctaatggatagaatatggcaaaagtgaaggcgtgtcgcctgcaggattaggtcacaaaggacagcggcctccatgctctctcctccatcacttgctctgatgtgagctgcactgtgaagtggctactggcgggaaaccgagcgcagcctctggccaagaacccatgagaagctgaatcttgcaaatgacccggcgagtgagttcagaagcagatccttccccattcaaaccttgagatgatggcggccctggctgacaccaaatgtaaccttgtgaggaacccaagctaagctgtgcccagattcctgccctgtagaagctaagatggtacattgtttcaagccactaggtcttagggtaacttgttaggcagcaacagataactaatgcagatgacctctcatccatatatgcagacagggtacgctttaggggacaattttgcaacagatatggactgtaaaacaactctgtgtccagctatgggaggcacaatggcctagtggccaagagcagggcctctgaagtcagaccaccaggatctgaattctggctctattccttgccagtcagaggaccctgtgtccattatgtgacctctgggattcagttcttcatctacaaaacagaggtaataataagagtcaccttataaagtggatgcaaagattaaacaagataacacttgaaagttgtttcaaacagtacctggtccataataagtatttaataaatgctgcctattatcattcttatgaggatgataagagagggtataatataatttttggaaattgagcatcttgctttctgcctagggagacgccacagctcataaaggaagatcatacaaggtaatagacaattaggtgctacatcatgttctttaggttctaaaagaaggagtttagaagaggttttttttttttttttttaaacaaaaagggatagactcccctggaatgtttcacagtgaagatttacctaggcaagaaagattattagactcgaagtgggcacaaaaggaaggagtagagaatggcatgtgcagagaagcagaggtagggacacaggggtgaataagagggcaagaggcttggctggagtggaaggtgagtactgggggaaaatgacatcaattagggtagaaatttacacaccatcggcaaaggctcagtctcaatgctgtaggattggggaactctgtggctaactcagtatttgcgaaaagtgctgcaaacaggagagtttagaggcggaagaacctgaaggctgagaggtgccatgttcttaggactggagaccagaggctggctggctgtgtctgtgagcccagaggcattgggaaggaaaggccccatgtggggatggagaggccagccctgccggaccagctgtggcatggaacgtctggagctatcttctctctggaagtgggtgagtctgagaatagctcccattacccacaagtcactgaagccccgaggcatgagtgtttgcaagttggtgcatgtttaaggtcaagggaacattgatttccgccctgagttgtgggagaagccgctaatttgataagacagaacattaaagattcagtgtggatgggtattgatcatggggggtggttcatgttagatgggattttttttttaaatgatcaaataactatgggtagaaaactaagtaagaattacccacctgaacctaccttgtttgaggtgctgtaaacctgagtaagacataatgcagtgattgagtgcacagctttgaaggcagagagatgtgggtttgaatcctgagttatcacttattagttgggtggcattagatacgttagccaaattctctgtgcctcaggttccttacagggacaataagacagttaatatctacagcaagaagtcattgtgagaattaaacagcaagatacacgtgacaataatagtataataataattgcaacaacacaaccgtgagttgcgtatagactaatttaattatcacaaccacccaatgaggaaacttgccaaagcttacacagcataaagccgagatttgttttgtttcgttttgtttctttttgttttgttgtgagacgaaggcttactctgttgcccaggctggagtgcagtggtgcaatctgggctcaccacagcctccgcctctagggttcaactgattctcctgcctcagccttccgagtagctgggattacaggtgcccaccgctatgcccagctaatttttgtatttttagtagagacagggtttcgccatgttggccaggctgatcttgaactgctggcctcaagtgatccacccaccttggcctaccaaagtgctgggattacaggcatgagccaccatgcccagccgtataaagccaggatttgaagctgggtactctgtgttcagagctggcactgttaactctggagaacacagttttaacataagactgcagtgtctggtatatgacactaaatagctacttaataattgacagcatatatgttgataggagacctagaagttcatgctgtctcttacattaagtctttgcaagctgctgaaatcatagttgtgattctggagggcctcactgttttttctaatggaaccgtgcagggatccatgcaaaaaaaagcaatggggggtcatgagccaccccagcctccacactggatgatggagacaagaaaaggaaaagaaagataatgaaaaagcaaaaacacacacataaaagcaaataaggaaatgggggcacttttggcattttgagtttgaggatctaggaaagctcatcaaagcctggaaagtgtcagcaaatgccacattgcatgcctaagtcccattcccaagagcatcaagtggtctggaataactaaaggactccggtaggctggcacgttggtggcctccagtgaatcacacttcttgggattcgtgcccttgtttgcctcctcccataccaactctgaccttggctgtgtgacttgctttggccgatgagacggtggcaagctcaaagcaagaagaggcttgataggtgcttgcacttggggcttgcccccttggaagccagccaccatcctgcaaagatgctttggcttgagcgatgagagagaaaacgtggagagggaccacagagctctggcctagctcacagctgaatcgcccagctgaaatcatgcggaataccactgttgtggttttaagtcactaaatcttgaggtgtctggttatgcagaaataaataacagaatcaatgactttattttctctcttaaatataattttcaattacacaaaatgtataggaatctcttcatttttaaaaaatagaatactacagataaaggctgaagttccatccccaatcttggtctccttccccccactgtaaaagttagcaagttaggggtctggtgtccatcaaaccaagatttttaaagaaactttcacatacacaaatatgtactcatagataatatatcagtttttgagattgcttcctactgcaactttggggcaatattgtaagtgaccgccttgatgtatttgaagatgaaggtgacagttctcccccataacacgtggtacagtttggccaataggagggatttctcttcttcaacactgacatggtctgaaaaaaaatcaacttgccccaatcaggcagcccatccgtctgctctcatgcttgtcatgaacctaaatcaatcagccagggaatttaggagccaattgtcatttctcatatcctcatggagaagaactccatctgggacaacttgttccagcatgatttgggaggatgacagccaagaatggtttagttttccaacaagggccacgtgcctccttgccttccttgccaacccccacccagtacctctgttccctgctacattccctacgtaaggaatatttgtatctggggagaggaattaggagaaactcaggtctctgagaggcacaatgttttgtctgagtttgcaaacgggacatgggggcttccagagttccccccattatctactttggaatctccttatcctggggcagccaaggtcaggcttgctgcctgggggcttgaccacccatgggatggcccaggaacagagtcagaggccagaggaacagttgagagtgtctctatctaattcacaccttggcaccagctcacgggggatggtgcatccaatttacagcaggagcgtctaatgggtgttaggcctcaccagacacacaccacacacttcacagagtgtaaagaaggatcagtgaacatcctgcaaatgagtcacaaagaaacattcagaaccaccgatgaattcatctaatatttcaatacctagaatgtgagcagaatgtgtggcataatataagacaaggcagggcaaacagggcacctgcccaccagccagtggcactgtcctcatgactgtatagttatgaagccatccttatctcctggaggtgaaaatgaataataacatcactctaatgtgaaattagggggagggcagataggctgtctgaattaggaagctaaaatagcaaacagagtacggtcaaacaaaactcctggcagctttgtatctctttagttatcatgcttagtttatatacaagtaagaattgctaaagtaacctataggacctaaaacatttttggtaaaggtgttatatttgattaaacaaatgatcacaatactttgtaactcattccatcaagaggtggagtctatttctctatctgggatctgggctggcctcatgcctttctttcagccgtagaggacagcacaagtgacattgtgtgagtcctggtggccaggccacacggaatagaattgaggcaccaggctgatggtcagccagtccccagccaacctaccatttcacaaatgagcccagccgtgattgactgagcctggctcagggcagcagaagaacaactcggaggacccggatcaaactgctgacccacagaatcacaaattaaataaatgattgttgtttcaaaatagagagttttggggtggtttgttatgcaccaaaagctaactgttacgtattttaaaaacgattccaaattctattgacttgtttagccgacatcatttcaatactgcgatctatgaagaaagacactcggcattgtttttctcccattttatctccatctcctcaccctgtgcatacccctgaatatgcactcaacgtagatttgttgagtaaaagaacagagtgaaatagacttctcttgctggcactttaattttttttttcccaaatgaggcagggaataatgataaatacaagataaataaataaaatagaaaggaaaaacacaattaaactatgtcttaattatgcaatattcttaattaatggggcatggatggatgaattttaaagcatctgtgagctccttctatccacccttcaacaaatatttatttactacagaatttgcatttcgcactatgctcacccccaggatacaacagataaggaagacggatagcatccctggcctcatggagctgtagaaatgtacaccattaattctgcctaacatagaattaatttcatgttagaactgtaggtagctacagttctgggcacggcagctcatgcctgtaatccccgcactttgggaggccaaggagggtggatcacttgagatcaggagtttgagaccagccttgccaatatggtgaaaccccgtctctactaaaaatacaaaaattagccgggcatggtgacgcatgcctgtcatcccagctacttgggaggctgacacacaagaactgcttgaaaccaggaggcggaggttgcagtgagccgaaatggtaccactgcacactagcctgggcgatgagtgagtgagaccctgtttcaaaaaaaaaaaaagaactttaagtaggaacaagtaaggtcatgggtacatataaccataacaaatgccgtctcatcctggtacaggtattttcttgcctgtgatttgatttctgactggtgtctttaattttttcctgtttatttacattttataataaattcaataataatagtaatattactataatattgtaatattataataataatagtaataatagtttctaacaaatatattagtaggtatacataagaggaactaaacagaagtatttcctgacctcgtagttctttcggtctggtcagggagacagagattatatgtataatcactctactaagcaaataattacaaattagccaagtgccacaaaggaaagtcccacagtatgatcacagggtagcatggcctagtctggccggggaacccaggcacagcaagtggcttggtatgatgtcatcacgactctagctggtgagttttaggacattcttgttatataaggttttgaggacttgggactgagttttatggagtccatggacttgaactgttggcttgtaagcaccctgcgaccgtgtggttccatctccctttgtctcccatctcacagttgccatttgtgggcatttttccattcatgggagtgctatagctaaagtctagatattgggacaagagatcatggatttgcttcctgtgccccatttcccacgggtgagccactgaaacctctctctgccatggtccacctgtagaatgaggacacacgtcgcctccaccccaccccctcctttttcattatcggccctcctttgccatgtgcccttggggcatctggggtgccctgtggcgcctctccccccacccaggcatgtggcgaagatcactgagacgatgtttgtgaagtgccacatgtttcgagaagagaggcattctccagaggaattccatgagggattgtgatgattactgagcctctgtggagagacctccggtacttggcaaggtgccacccccttatctggagacagctgctgcctggctgcccgtgcacttgcaatcacagacttttctgcttcacatacagattgcctggggctgcagcaggcaacaggaggggatgcagacgagagctggtgcccacacctctgagctatcggtccatgtttattcattcaacaaatatttattgagtgtctactatgagcccttacatgagtctagacattgctggggcttgaaagcttataatggaggagagaaattgtttatgacttgctagcgatggggctcagcaccaagccaaataatatctcattaatccctttacagatgaagaaactgctgttcagtgacatatagaggagcacagagttagtaaatggtgcagctgagacttggcttgatgtcagcccaattctaaacactgtgatctttctagttctgcttcaggaacttacaaagatgcccaagatctccacctctacagaagctgagatccttaaacgtgggcacagatctgtatcagccctctggcccccagctcaccaaaataaacacagcctgtagaaagtcacattcttcccctcctgatcctggagccaccttcttaaaaaatgtctttcttaggctcaggcttgatagagattcccaggtgcaggcaagaggaatgttccaggcaacggaaccagcacatacaaattcacagaaacaacagagatgtatctacaagagtggacctgggtctgcttggtgaaaagggaagagtccaggaaagggaaagatcaaaggtacaagagaaaacaaaaaggaataattgatggtggcaagatgggatcaaaccaaacatccagctgaagtgataaagatgttttctgcacaggcaggaaggttagatgcaagaacatttaaattaaataaaggcaagtgatgatcactaggatactttaaaagaatggaaaaggtttggcagcttgagtagggaatgggaatgatgttggcaaatcatttgctgaaatgttatttaaaatagcaaaagagtggaacagcctcagtgtccagcaataggggagaacttaggaaaattctgagaaggatactggatgggatactatgtagctattaatagagatcattatgaagattttgtagcaccatttttaaaaggctcatgatgtaatacagtgggggaaaactatagaaaataaaaatctgctctattttgattcctaagtggaaaaaaacaaatagatgaaaagagaaagacaggggctgggcatggtggttcacactgatagtcccagtagtttgggaggctgaggcaggaggattgcttgagcccaggagtttgagaccagccttggcaatgtagtgagaccctctctctacaaaaataccaaaccaaaaccaaaaaaaaaaaaaaaaaagagagaaagagagagacagataagcaactccatggagcaatggttccagagtagcccacaaattccattaattacgtgatattgttggcaaaagtatgtgtgtgcacatgcatgtgtgtgtgtgtgcgtgcacactcactgtatgagtaaatttttcctgagatgaggtgagagctccaagatttcattactttccaaataggtctatgatcacatcaagactatagaggaaagttcaaatcattgtaccacagagaatgttcatttttggttgggattctaaagttctttgacatagctgaaaagtatttttgcctaacatttaactcccaacattctgaggacccacattacaaatgatttttgtgcgggcccaggactttgctctgcaggattcaacgctgacacactcatacacactcacacacaggcacacacacactttctctcccacagtgagtaatttccatctggtctcccagttctccttcctggttctccctcattagggaactcttctgaggagtgaaggaatctcttactaaaatcatttcagggacctcatagggctttacaaaacattaaatcgccacccaatgcatggtcatgggaaaatcgagctccatggctttggaaccaatctgaggtactcaaggcagaaagagatcccatgaggctattgaaccaagatggctcaccgcccagaagaccacatgcccttatatcaaggtggcacacttcacagcgtggagcaggaagaacagtgtgcaataaagaaaagaaaaataaccacttagaaaaacacatgtttcacggcttttgaataattaaaaatgatggtacctttgactgggtcatgtgttcaagctggcccacagagacatgaaaacattctggtgctgttctgatccagcttatagtccttcagtcaccaaatgtttactggccacctcccacatgcttggtttctccctttccatcaaagaacaagaaaatcatgtggctgtgggtgtggaaagaatgaaagggacttaaggattacaggtgctgtccagcccaccttgggcttgaatacctctatcaccagtcaaatcaacggtatcctctgagcctcattcttcccatctgtaaaatgggtggcattacttattatgcaagtcatatgagaactccgtgagtgaatgtatgtatggcaccaaacacaagatacaagcacgtagtaggtctactctgacatatacatagaggattaaggaaggtctttttttttttttttttttgagacagagtctcactctgtttctcaggctggagtgcagtggcatggtctcagctcactgcaacctccacctcctgggttttcaagcaattcttgtgcctcagcctctcgagtagctgggattacaggcatgtgccaccacatctggctaatttttttattttcagtagagtcagggtttcaccacgttggccaggctggtctcaaactcctgacctcaagtgatccacccgccttggcctcccaaagtgctgggattacaggcatcaaccactgcacccagctgcaaagaaggtcgtaacactacatccccttttatcacccaggctgttgagcagaataaatgaattaatgaagtatggaagagctgcaaaacaaaacaaaaagcctctgtaaaatgttacagaaatatcatgatatgagtaagctcctagcctgtgtaggtgtgaagctgcctcattttccaaaggtcacaggctccccattttacttatggtcttttcctgtgcttccaaagagtgtgaattcagttgctgtggtgagctctttttctaggttctagctgagccttggatgagctttatcatgctaagggtcaacatatccccagacagaatcgtattttaattcaacagcattcagtagttattaaactatgataaatgctaaagtgggaaagattacacttagacataagaagtgtcacttgaatcacttaaaaatattataatgtatggctaattgcaccttgactatattatccagtgctgtgaaaacacttcagatccttaagtaaggtaccatttaaatacctatttcggtatgtaatgggtaatattcttgagtgcaaaggttgttaaaggacccaatattcattgagtatctattatgtgctaggcactttgtccacattaattcatttaattctcgaaacaattaactcatggaggcaattattaccagccccattttactggtaaggaaactcaaattcagagacgtcaagtaacttgcctaaggtcacacagctgataaatggcacagctgagattggaatctgggaaagccatctccagaatccactgtcacagacagatacaatgtgacctctgtgacttctctgcctcagtgtcctcacctataaaatggtgtcagtaattatactaggtttttgtgaggattgagatgagcgagaaaagctcagaacacagtgctcagtaaacgaaagcattattttctattgtcattattgtctcctaaaatgccattctatcacgcttaagctaacaactccaggcctggggtttgctttggagagaaatactttctacttgccagcatggatttagtagggttgaaacaatacagtgcacaggtctaggcgcagaactggctacataatttccatggtccattgcaaagtaaaatgtggtgtccttgtcaaaaaacattaaggacttcaagatggtgatggcagcgcactgaaccgagcaccgggcttctaagcatcagaatctttgcaaatgcacaaatcgaatgcccgtgaagccagcacccatggtgggaatcgaggctgccttagctacaatctgtggtcttggggaatgcagtggaactttctgagtctctctgattgctcatcagtaaaatggagaccattcctgcctcacaggttataggaagaaccaaacaagctgttggatgaaaaagtccggctccaccacaaaacagcatgccagtgcttctcaatcctaaccatgcaccaggaccacctgtgagcctgctaaaaatgtagatgctggtggctcttgctcctgaagatttggatcaggagggcagggctgtgcttctgtgatattaaaaagttcaaggtgattctgattgtgctaacaagccaaagatattctttagtataagaacactaagcttaattacttagaattaggatggtcctttctctctctctctctctctgtctctcaactattacagtcaaagcatattcgaagagccaatcttttgaaactcaccctatgaaattgtttcaatatatcgcttggtcagactgtttgtgatatggctccaggacacacaaaagatcccttttatgccatcagacattggatgattcctcacttgcaactgtaatgtcaaggccaaagttttcacactgaggtcagtgcctcccacccccagtcttccggcttcctgctgccaaataactagaacagaccagtgccagtgagaatggataaaccacagcagcctttctttggaaacacttcagtcaagggagaaaactgatcatcatatggtgatggctttcatgccacctggcacatgctcctgtaactcagctgcattttcacctgggtgtcagcttcgggagtcagaacggctacatctgacaagtcacatgcatcctctcatcaaagccatttgatttttttatttttattttttagcagactgcgttctccctgaacaaaagtattaatgaaggttcgagcatatgggaggcaggtttaagacatgtgagagcttcagggcagtggggacaaggcaaagctggcacatacatgtgccattaatggggtgtcatttgggtggcacataaacacaaataggaagctcagagctccctggagtggctagctgggggtcagtaaagcccgtgtgctaaccccataacacgatgcaagctcaactcaaatttccaggctgtactttttcccctactacatatactggggctgtcagtgtgattaccaggttatgatggtcaactgcgggaggcttctatccccacggtgccatgcacagctcagcatcctgatccaatcaaagggccatcttggactgtcatggacactgctggctcctttcttttggcacttgaatgcttaaaaactcaaccaatatatgcctcactggccacaggtctgtccttcactttctctttttccagtcatctcagacataatgggttcctccctgttttttggacaatctgtgatggatgtatgggtggctgacaaccaagaggtgcaagatgcttgggaatgaagggagcaaagaagctctttgagataatgctctcctgattggaatccttttgggaagccaagtttttctctcttaagacctcatcattggccaggtgtggtggctcatggctgtaatcccagcactttgggaggccaaggtgggtggatcacctgaggtcaggagttcaagaccagcctggccgacatggtgaaaacctgtctctactaaaaatatgtggtggtgcgtgcctgtagtcctagctactcgagaggctgaggcaggagaatcacttgagcccaggaggcggaggttgcagtgagccgagatcgcaccactgcactccggcctgggcaacagagcgagactccatctcaaaacaaaagacctcatcattgaattgtagaatgttgcatatgcaaaggttcttaaggtcagtcattccaacccccaattttttattttattttttgagacagagtctcgccctattgcccaggctggagtgcagtggcgccaactcggctcgctgcaacctccacttcctgccaacctccaattttacaggtaaaaaaaccgagtaccaggtaagttaagtgagtttcccagtgttaaatgataagaagtggcacaggcagggcaggaagctccatccaccaaaaggaactggtgcaccgggtgtacccctcagtccatcttggtttgctgtagcaagcactagtgaggctcacagaggcagcttctgtggaacaggagctttcctttatcatgcttcctttaaatatggtttcttcatcctcatgctaagcccattttccatacctcgctccacttcctggtttattgctgcctggtttggggccctgaagtcaatgtcactggtaaatagttcaaagtctctcttgctgatcgcaatgccctttccctcccattcaaggtctcggcccagcccctctgggcaagcagttaagattttcagtggctatgagcccccttcctggacctcttcactctttttcaagcctaaacatcagtgctgcgttcacatgcacatgtcacgcgaatttttctactctttccacttccaacatagcttctatttccaagaagtcaaagggcttttcagagtccataaaagtctatgtacacaatggcattttatactcagcagtcttccctgggactttttcattttctgcaggtgatccggagttgagaaatgacttctaaatcctgtctactctcatggctgattaaagtccagaagtccctgtagtccgcctaccagtacttttgtgaagattttgcataactactgaaaacagtttaaaagatcatgtctgtgatctattaaacaaggtttttttttaagggcaataaagggtttaaaaggaacatgtgagacagaaatatctgcgctctgcttattatacattagaaattataagaataacacgtttactactaattacgcaagtcatttgtcacgaagctcttgccagaaaacgtatttgaattcccccaaattcaaataaagaattaatgggtaaataatttatactcaagtaattatttgcaagactttatttaaactagaatttagtcaaagttaattcaaaggttttattccttgcatcctgtaatgaagttgttgtttaattagaatgacaacttgctcctctaggtaaaaggaaagggaaatgtaaatttcagcgatgattttctctggctgctcagaataaccatggccaagatggcccatgattttgaggaaggacaggaccttggatgattccggtgacactggagagaagcacagaatttccacatgaatcacagtcctggggcttaggggcatttctttagtaggaccgacacaaaacaaaaatagtaatgaaaccctcaaaaagctcgcagccatccattaacacaaactcagtgacacctacatccgaaacatacaccctcgcatgcagacaccttcacacacacctcttcctggctaaaataaataacagtcccaatcccacccctaatgacaaaacacatcccagatgctgtcaagttgctttcacagagtttaatgagttgaacatccagagacacacctgtagttgccactggtcctgaggcttctaacttttccagtgtgaaaaattagagacacctgggcctggggacttatatttgtggggcgctggtgaggaggtttggggggggggtggttccaaagtctccagatccattttctttaagagagagaaattgtcgactgcttttcaccttccacttctcaccaattgggtggctattcatttcctagccctttggccgaattgtgctatgtttcatgaagcatcgctctcaggtcaggaattttgggtgagatggatcaaataggaagagaccaaatgcattctacccccattgacctaggagccacgagcatgcagtggcaaatggtcctcaggagatggacctttgtggggcaatatggaagagcctcttaatactgtcctgtccatgagagattccttcaggggtgaccccaaagagtcttagcagatcaggatgtggaaactccccggggatcctgtccccttccagttcaactcctgctagccagaaaaccgagctaccaccaaatgaactggattgccaaagaaaaatgaaagcagaaagtataggttctgctaaggacaggtgcatgagattatctgtgttcaaagaataaaatgaggcggtacatgataaaaattatccttctgtgcctcaggccatgcctctgaacacatctttggttcagaaatttacaaagagggcttcacaaactcccatctctgacattactatgatgtatgatttccctacacaatacaagaaagtgtagctggaaattttgagttaacccttcagactattaatgattgtgcaaactttggactcaaatcacttacaaagctattgaagaaagttatgctgctaaaataaatgctatgttattgcacatgagattgacaggatctgcaaaaatcaaagctacatagtacgtgcactcttgggatgagaacggggatggaatgcagcatgcacggggtaaactgggatgcggcagatttgccagatcctccagcccttctgcaggtccatcagaatcacctatcgacgcagaggcaagaaaagcagttagcgcagaaaatgagggagccggcgacaggaaaaacgtgaagcaaaagagagcaggtgggttatttcttaaagaatgacatgtttggaatttttaaacatatatacagacatatatataattgtatagtatatgaaattatataaattatgacttagttttttttgttacagaaaataacaaacctccatgtattcactgcttagcttcaacaatgatcaaggccagtcttgtcatcggccattcaaggccaggcttggtcattggccattcaaggccagtcctggttcatctattcctcccactctccttcactttattattttgaaacaaatctcagacttaccatttcatctgtaactatttcagcatgcatctctaaaacaatgatacagtttaaaaacataactatcataccatgatcacacctaaaaagatttccttaatgtcatcgaacatccaggcaatattcaaatttctctgattgtcctatacattttatttttgaagcctgaattaggatccaataatgtccttacattgcaatggtcgataggtctttttaagtctctttaatcaatgtggtgaactttcaatctctttttgtcctgggtttttaaaaaaattgttgttgaagaaactgggtcgttagtgctatagagtttcacacagtctgattttgcagattgcattcttatggtggtgtttacatgttctgctgtctcctttctctctggtaaattggtgattagatccaatggcttgacagggttaacttctttggcaagactgtgtcataggtggtggtatggatttctatcaagggatttcattgcctgctttgatctcttttcttgatgtgaatagttatttataataattgcttacatccgttaattctttaaggttcacaaaatgggcatcttaattctaacattctttctcttcttcctccttctccttctcttcttcctcctttttaataaagctggaatacttctattgcatgaattttccccccatttggttaccttgaggttttggttttccttcattcattttgaatcattataaactcacggatttaaacatatttgatctgtgcatttcaatcgattgaaattcatggtagttatttttgataatcattttgtgtcgtctttggctgatggcacttcaagttgactcatgcatccttcctttttgatgtgacaaaatgttctggcctcatcttgtatgtttccttcctgagatttgaaactagccatttctccaaaaagccctgggtccttttagtgagaagcagtatttagaagccataatttggatgttagggttggtcactgttaatgggttagtcaccctttccaagccttttcagtgaacacagcaaaaattgtagacacacacacactccatataatatataacatgatataactatataggcatttagagatatttaagataaaatacattataagtttatactgatacttcccattcaaattcagttacaagtttttatttaactttattgatccttcagctgtatctccttttctccatgctaaaaaatctcaattatccatgataataatctaaatacttatttgctttatcccacactagacacccaatagtcccaggaaaacagaaatccaaccatcagcgatatcattactgaaaacagcttactatttttttataggtctttttgtccttaaggatgtacatcaaattactatgctttaaaataatttagatggatccttctctgtgatcatgccatccactggatacaccgttgggttcatttatttcatgttgattttgatttgaaggatagctttctaaattttacttttggtttatacctctgtaaatatttacatatgtctgaagtcagatgtacaaaagaaggtatattcagagaagtctatctccttgccatcatggctatcctgttcctcctcctttccactacaggtaactttaagataagttatagcttactcttttggtttctttttaacaatacagacagctgcctttttatgttagattttatataatttttttgttatagaatcagcagttttatatattatagaatgaagttttctaaactgttgctggatcataattgctgaagtacagttttaaatcctagaacagttcaaatttaagaaggtcattaccgacttgttacaattctttaacattgtagaaaatgcttgcaaaattcttttaggttctggaccattttctctctctgaccttcactcagctcgtccgtagaatttttcagccatgtcagcaaggcttctaccacctacttgctgaactttaattcatttcattttcatgaaaggaaggaaatcccctgaaatcatttattagttcttctaaaaaggcacagccatctgggactttttcatgtttgttgtgtgagcagccatgtcgtgctttttgcatcattggctggagtcaatgttgaaatcttaattcatggtgtttataatggcaacaaccgtacgggaagatttacactttccaggaggcgtggttgagaggcggatggaatgtggcagtcgtgaggaggaggatgtgcatcttctgtgtcaatggacgacatagtagatgacccaccttacattcaatgtcctgctgagtaactgatttctctgtcttgataattataaaactggtcagagagttgctccatgatctaagacattttactaagctgccaatatattatggtaagaccttctaattattgccctttaatatcctgggctttgcaaaacagtaactccaattttttcagaaacattttcactatcatgactgctttttttttttttttgagagacagagtcactctgttgcccagtctggactgcaatggcaccatcttggctcactggaacctccacccctcatcttcaagtgattctcctgcctcagcctccccagtagctgggattataggcacgtgccaccatgcctagctaatttttgtatttttagtagagacacggtttcaccatattggccaggctggtcttgaactcctgacctcaagtgatccacccacctcggcctcccaaagtgctgggattacaggcgtgagacaccatgcctggcccacggctacttttgattgctgcaacagtgtccccagtggtctccctgctttcactctgtcccccacatgtgaccatcaaggaggactcagacctaccaggtattaagacttaccataaagccacagtgattaagacagtatcagcacagagatggacaactagatcaatggaacagaactaagagcacagaaacagacccttgcacatttagatgcttgcttcatgacagaggtggtattggaaatcaatgtgtaaagatgagcaccactgtctctgcacatctttccatctcagctgccattcacagacatcactttcagtagctacttggtactcagccgtatgaacataccatcatggtaccaccatttatttaaccaatccccatcccttaacatttaagtgactcctttgtgttttttttttcctattataaacaatgctgcaatggagatttttgtatttaaatatcttatacaggccaggcgcggtggctcacgcctgtaatcccagcactttgggaggctgaggcgggcagatcacgaggtcaggagattgagatcatcctggctaacacggtgaaactccatctctactaaaaatacaaaaaatgagccgggcgtggtgccgagcgcctgtagtcccagctactcaggaggctggggcaggagaatggcgtgaacccgggaggcggagcttgcagtgagccaagattgcaccactgcactccagcctgggtgacagagagactctgtctcaaaaaaaaaaaaaaaaaaaaaaaaaaaaaaaaaaaaaaatcttatacacatacttatgtccttagttaggattaactcatcagatggagctaataggtcaaagagctcagatattttgggaaagcatggtccacatttctttcctgaaaggcctgctactcccactaacagcctatgaaagagtcaacgtgcttcctctgacaacttggaatatcattactttaaaatctttttgcatttcaggagtaaggaagggtaacatagttgttttaatttgcatttacttgataacacataaagctaatcattcatccccaccaaatgattggccctttaaggtttttcttttgtaaaatatttgtttttgttcttatatggttactaaactgctctttctcacaccactccaatccaccaggtatgacactgtgaaattactatctctaagtaactcttgtgtacctggtttcgctgttctaagaaattctaaaggttaaatgctaaaggttaaaaaaactataaaaatacgtacagataaatttaagataaaagacatgcttcttgcttcccgcaagataagggccaaagtctttaaccagaggttgatctgcaccaaactaacctcagtattctcttccaccataaccctcgtccttgaccaacttggtctgctctctgttccttctccatgtgacatattcctccccccatgctttggctctcattgctctcatctcagaattttcttttcacttgctcagtttcttatctccctttatgccaagctcaagtgcattatccccttaaatctttccctgggagaatatcacctctgaccttccgagatacttactgtagtaccttcccatgcttcatgccatctacctttttaagattgtccttttgggggcacttgttctaactgaagtgtaaaactctcaaggaagaagacagtacaccttgaggttcttttatgctagtgtttcgtacagtcccaagaactcagtgtgtggatgattctgacgatcccacgaaggaggatctgtcaatggcatgttgaggagggggagatgagatttctatacccttgtatctgcataatcccaaatattttttaggatgtttttactgaattttcagatgtttaacgataatacctgatttcttagtcatggaggagtaaaggtgttaagggcaagtagaggttatagtgaagtctgctgaagttggtaagcagccattattgggtcattctggaatgccttggctttttacttctattgacccccaagccccaatctcagcacaggccccaatctatcaccccacaagccccaatctcagtgctgtattgtgggctggcagactctggacaagggaaaagcagcatacaatataaaatggaataaaagccaagttccacctctgctacttacaggctgtatctccataggcaggctacctaactctcttcacccacatagcagagacagtaatatattccccaggattcttgtgagaatgaagtaagacaatgtgtatagagtatgcaaagttatctccacagagccagaactcaatgcatggaagctatcaatgtaagcagaaaggaagaggaccctgctggtcttttctgtcttggcatgaagcaagaggttgggtcaacatgagcaaaaaaataaagtcaggcatgtccaaggtaataagggacaaagggtggagtcttatttggggtccactgctaaagcacttatcctactctgcagggcactaataattcctgtgccaactcaggggtaaattaggatggaaattgcagagtgtctgtgcaatgcttacttctgaccgaaggcagcatccaggcctactgagagtcactggaaacaaccaccagaaattttggagactaaaagcacagtaactgtgaaactcctggaggaactctagaatatagctacattaattgattctacaatgaaaactggcaaaggagggtgaaaacgtaaagtacagatgaagcataaccaagcacaagagaaagcaaaagtagcaatgtggacatcagaaaaaaatgaaatttaaggttgaaggtataaaacagaatggagaatgacattatataatgttaaaaagcacagctgataaaggacatataatatccataaacctctatgcaccacacaacacaacagttaagtatataagggaaaaaagagcttaaaatacaagattttaatgaaaataagagttggaggtatccatagacatctctcagaattagacatatttacaagacaaaaaataagaacagagggaatccaagattttttaaagagctcagtagaataggtaacttgctatggttatgttatctgcagaactagtgaaacgcactgacacaagaaaatgaagtcactgtcatcaatattgagaaaagtagataaaattatcacttttgtgttgatatatctgaatacctagaaagcccaagagactctaatgaaacactagtcaaataaattagacaacttagtaaagatagtaaagatgaatacacaaaaatcaattgcttcactctctactagcattaagcacccagaaacgagaatgggaaaaaatgacaagagattaagaagtttaaaaaactttaaaaatacttagagagaaatttaatgtaagaggaacttgagtggccaggtgcagggactcacacctgtaatccccaactgtttgggaggccaaggtgggaggctgatttgagcccaggagtttgagaccagcctgggaaacacagtgagaccccatctctacaagaggaacttggacccagagttatatattcctggggtcactctatcctcaccagtgaggtctgaatttcaaccctaggttctctgttctatctttgcttgctctctttcagtcctagatacagtagctgcttctcgcatttactattcctatcttccttagagtcttcttttaactcttttagtagttaaccactattttactagttaaaaatcttacataaattttccctgtttaaattactggtgtggtttctctctccagaccctgactgatgcagacctatatgaataaactataaaatcttattgaaagaccccccaaacaagaactaaacaaatagatatcttctcagatagaaagacttaatattgtaaaatagcttttcttcccagaaaacatatataaatttaatgatattctaatcagaattccagtaacattttcattatttttggaaacggttaaaaatatcttagattcttttggtagggtaatttcatgaatagctatgaaaagcatgaaaaataaaaattgtgatgagggatatgactagctgtatataaagccatagtaatcaaatctaagtggtttgggcagagagagagagagacaaagagatgagtggaaaagaatggaaaaatcctgggaaagatcttaggatacattggaatttcatctattacaaagacagaatttcatttcacagggcagaaagtgatttatttttaaaaaatgggctggcaccaatggctagtcatctagagcagagattggcaagctttttctataaggagccagatagtaaatattttagaccaggaatatccaatcttttggcttccctgggccacattgcaagaagaagaattgtcttgggccacacaaaacatatactaacaataacaatagttgatgtgctaaaaataagtaaataaataaaaaataaaagtctatgcataaatctcaaaatggttaaagaaagtctacaaatttgtgacaggccgcattcaaagccatcccgggctgcatgcaacctgtggactgcgggttggacaagcttgtttagactttggtctaaaatattatggtctctgctgctagtacacaactctgccattatggtgtgagagcagagctagacaatacataaatgagtgggcatggctgtgttccaataaaactttatttacaaacacaggcagctggcctgtgggccatagtttgtcaacctctggattagaggaaaataaagtagtcccccatttctgaccaaatacagaaataaattccagatggagcaaggacttaaatgtaaaacataaacctcttagaagaaaaatccaggtgcaataaggtatgattatattacgaagggtatccatcataagtcagaaaattcagaagccataaaagaaaagctggacctatttgagtttataaaaatgtaaaacttttatacgacgaagatgttatacacaaagtctgaagataacagatttgagaagaatgtttgcagtacagatgacttatatctctaatctacaaaaggctcttaccaattggcaagaaaaagacaaacaacccaacagaaaaatgaacaaagggtatggattttagtttaagtgcgattggagcccttggaggtttccagcaagagaataatatgatttatgttttaaaaagcccactcaggctgctgtgtggggaatggattgtgggggggcaggaggtaatcaggaaaccagggaggctggctggaatgtttttgcagactaccccacttgccccaagagaaggcttaatagatgttcaataaatgtaggctgatttttgatgaaaacatctgtgccataccccgctatggaatctaggccaagtgtccttgagctgactccttgatcctttccttgagggtatgtgaggttcagaacgtggtaagactcttttcaactttcaatagaaacaaatgtgtgtctctggttgatgaaacccaagagctgggatgagggctacccctgagaaatcctgccatacttatccacacctcagtgctgttgcccctcttggctctgattatggaaaggggaggcaagaagacctgttgcagtctgaaggaaccggtgaattcttagttaaatgaggcaggacacaggagacaggggatgaaactgagaaggaagggggatcctaaactaacacaggagatgacagagcacatgcttggccgctctccacatccccacatggggaggagggggttgcactgaataatctcttctcttaaggcttggggacccaatgacttaactgcaagtcatttgtctgcacgtgaagccaacagttttcaagtgatcagtggtcaaaacgaagtaacgacttgcttctcctcagctaggaagtgggtttggaaactctggccacccatccagcagcaggaacagcagctggagtgacaggcagcacaaagaaatgtccctccctccctctgcaaggtttaggaagcccgaggcaaaaagccgaggctgtagagcggcactgggcctggagctggtaactcaggctccgtgcagagcctccgctttttcaaatgtaaaataaaaaacatcctggacaggagggatctctggagaaaaatgaaagaacgcacacagacgagagctgccggggagaggcagcggagctgacattttctgcaaagggaagagaatagcatcaccgcagagggaccccgcatccagcaacagagctcttgcggctcatctttgtggaggcctctctgtttcccgaaatcccttgtggagcaagcacaagaaagtggatccgaaggaactggaggggtggggggtgggcagtgttagctcccctccaactctgcccctcacagctgcatccggccaaattgaggatgctctattctccatgactgagcctgtgtctggtttcccagggagatgggcacaatggaccctgcttgccaacgatgctggtctttaacaaaacagcggtgcctcgtgctctgcacaaacacacatttctgcacacccagaagaatgcatgccttccaaagagtatctgccatgtggtagacactcaggaaattcaggatcctgcaatcattttaaaggcctcccaaatggcgagtgctccacgaacacacttcaaagaaagaaatgaatgaatgagcagattattttggaatcacgttctaataatccatctggatatgtagacccccaaacagaggcaacaaccatgtgaattcaattcctgccatgatgtcagatgctcttggccaggaattggcaaactgcagcccaaggaccaaatctggcctgcaccctgtttttataaataaagatttattggaacactgccacacccctgtgtttacatatagtctatgggctgtttttgagctgttaacagtaggccagcttgagtagttacaacgagatcatatgggctgcaaagcctgaaatatttattatttggctcttcacagaagaatttgcagactcttgctctaggcaacgtcctggatttagcaggtctgaggtgaggtcaaggatttcatgtttctgagcagctttcacttgaagttgatgcagttagtcttggagacaccctttgcgaagcaaggttttaggcactctctttttccaaaacaaacaaaagtatgatgaaccattaaacattaagtaccaatcctgtacacagcatgaacttggccctgcagtatcacataacttgagtcagctgtaatcaaagaaagtcttggacatccctgtttctcacctcataggcctcacttactgataggagcctagcagcatacacagcatacaccaaggaagagactggaacattcctgtttagttcatcaacagccacaaatctagacagacagctcagtggacattcattgccttttgacttccagcatccattcattcctcacccgaaggcagcaattttgaaatatttctctcttcccatttccattaatgtgctttgggcagggctgactccaggctcagcccaatcagcatcttgcatccctcctacgttaccctgattggttcaggggtgaacacctgacccactgggttcccatgggacttttgcggggacttctgtgaaaacaatgttctctctttcctagagcatctgtagtgagacaacatagaatctgagctgctgtacgcatttcatgacgctaagaaggcacactaagaaggaaaagaacaagcatggaggggacagttccaagcaacacaaaggagaagaaacttggtgactttgtttaggctcctgatcaaatgctacccctagccacaggatgttcccatgggtttttcagttatatgagcccacacatccctttttgcttctgccatttagagttccaatttttgtgctttgcaattgaaaaaaaaattcagataggaaaaattactaaaactttccgtctgactgtggctgagcaattagggccatgaacactcctgcatgtttggacacattttggcacatctgcaggaggagcatgaataaacggctgcctgtcttggagctgaggcacttgctgccttgaccatcaccaaggctgctatcacttataggccctggcagctccaatctctccaactgcaaccagctcatgtcaaaacagtcccgcagtttcaagaaaaaggatcctgggaaagggttcaggaatcctgctacgagtcaactgagcaacgtgttaggttttgaagggaaggtgagggttaaagaaagacacacacagagaggaagtggcagctatacagcaaatgcaggctttatgtccagcataagacctccagaggtggaggaccagcctaatgccagtgccccccactgcttacaggctggggtactcacaggtatgggcaggaggggcctgggcaggatggcttgctgcctgggatgatattgctaagacattgccatgatgaggcagtttggcctttgttcccacggaaggtgatgttccttgcactttctcccagcagggtatgataaggatgttcctgtgccttgtggtcaggtggctgggcaggatgtgtctcatgccccgaaccccagtggaatgtttcacttgaccaagatgtgtgaaatggtggggggtggggggttacaaaatgatgcggtttggtctaacacaaagaagcactaaagaaactaccgaagggtaggtcatctcaggcgaaactataccaggtaatgttttctttagcaccattccatgttctcttagcatcttcttgaccctaaagtaaccaatgctcactctcgctctctttctctctctgtttctctcccaccgtctctgtctctctctctctctttctctctctgtttaactctcttaccaaaacaactttcaactagtaagcagataggaaaggaccttattaaaaaacccacaggactcaggttcaccagttttttaaccagatagatctggatttgaattccaggttcaccccttactagatgtgcatatatgaataagcaacttaaatgctctgaatccccgtttgcttatttttttaaatatatgctttgctgagttatcatagggagatgagataaggcatatagtggttacgtgtaagactattatcaaaccataaaaataatattacggacataacattaatattgttttagcctcctggaggtgtttgcattttcatagggagcaattcctttcttaacccaacattaggaactgtaaagtcagaatttcagcctcagcgacagacctattgctaggtttatatctgacaggtggctacttaaagaaggggttcaagagccctacacagtccttaggcaatgaccctgagaatcagaaactcaggccatatatgtggaagcaaaaaaaaaaaagattctagagattggaggagttgctgagtgacaatcaggctgtcatcactgaattctgatgggctacctggaactggcttagggtgggattacatacgcctcctgccacatcggatttccttctattttgtcaggggtggcatcatccagtgagtaaatctgttagtgatctccctcgcataacctaggaattctctcaggatccatttttccagtagttttgagaaagcgaccaacaacagcaaagagagtagttcttccattccaagagcagccatcttgcttaactgacaaactagagagaactgcaaggactcagtacatccctggcacagtccattctctctcacagcatattgtatgagactgtgtgagtgctgcttccacgctacactaaaaacccatggtccctgcattatttgagcaactgacaagcttctgaagttcaggttcgcgaacgctgagagcagcacccagtggatttgtggcaggtgagcagatccttctcatctcccattgtggaaatttcacatttcattctgctttgtgaatcccacaacttcatgacaagatagattaacattttgcaaaaaaaataacaaataatgttctgcttgagggaaaatcagacattaggcttcttataagaaacaaggggtcatgttgaagacttcaggataacatatcttggagaagaaaaagccattcagtggttcactccccaagtctgtggcagggtttttttgtttttttgttttttgttttaaaggttattttcataactttgagactacaattaatttctgtaaaacccacggaaaaatagcctcttttcaataatcttccccccatctttttccccaagagtctttaaatctgagaaaatttttcttttcaattaaaacaaaaaattgaacagatgtgcctcaagagggctggcagtacttttaagaactggtaataatttatttagaaccatgtatagtaatataatatatctttatacacaagtcgcacataaacacccactgcttttggtgtggtacttactgttccttgttggaacacccaggaaacttccatatgtcagagatcatgtatgacagtcctatcttctgtgtaaaaggtcatctcccagcagaagaatagctcgcctagttaaagggataccaatttttaaacgctctgccaagctgaagatggagagaatgagtgagagagggagatgtcagatttcaaatgcagggcacgctcattgtgccctcggatgctgagctgggaggagggggagagaaacctctatttagagatgattggaaaaaatcagtgccacacagtgcacttgagaagcaatgcggcaggctattcttgccctctccttggatgtgacaaaatggccaccatggaaacaggaagcagcagcaaatggctgccacaggtcttcttggatgcttgaggaagtgtctatgtgtatccaggcctgtgtggagtattcctagggtagcaggtttttaaagtcagggtgaagaaaagggaggcatttagaaggaatggacaattgacaaagaaagtggtcagacagcaccaaagggtaatgatctgggaaaatccaaggttccaagaaagtacgttgaccccaagaaacttagaatttacagtattttagccaccttgaaactatataaccatgccagctcaagtaaccaaaaatatcctagtccctgcactagccgcttttgaaatatcctgtttaaaatgaccccctcaccaccacgggtaagttgccaggggattggaggctccatggagggctatccctaagccaacctgccaggcaggcaggcaagtttctgccctccccaacctccccctgctagctcctttcctcctgagagtcgaagacttcctgatgttcctggttgcatcagacaccaatctggcccaacttccctattagaaggcctctgtgacaaccagccaatccgatgcaccaatctgagtaactgttttccctccttcaggacatggttacatttagttcgatcttttccttcccaaggcagatgcccaaagcaaaaagagtgaagcagtcagaatttcagacactgtgaacaactccccttggggtacctctggggctggcgtctttacatcacgacgacagaaagctggcccgcacagactatggccacggcgtcttagaggttttgtttctctgcaggcgtccagtgctctgtttctttccctcctcaccactctccaaaccacactcacacaaatacacgtccctatgtgcaaagacgcgcatatgtatattgtatatcagtgtgacactcacacatacgtgcggtgttagcatagcctttccccctcgagtccctgttgtgcttcccagcacccagcatcctccaaagcaggcagtggcacactatcactcataaactaaatccagccactgcctgctttgtaaataaagttttgctggaacacagacctgctgattcgtttgtgtatcgtctggctgcttttgcactagaacggggtggagtagccacaaaaaaagaccatgtggtctgaaatatttgctcactggcacattaagaaaatgtttgctgccctctagtctaaagcagcatcttatatctagaaaatctattccttaaaaattgtcaaaaggtctttctcttatcttaaaagtgattcataaacctgtacctcttagagtcatggagccatgtaattagaaggcgtattttagattgttagtcctacttatggcctagtacgtgattctcttctaggatacctgtggacgtctcatctctcttgatggttccagtaaaaggcaacacacagctgctcacagggaagctgtgatgtttcccaacagctctattggaaagttcttttttatccgcagtgaaaatctgatttcctatcatttccacccactggttcccattctgccctttggggccagtcaggaaaagggggacgatcctttttgaaaaatcggccaggcatggcagctagtgcctgtaatcccaacgctttgggaggcagaggcgggtggatcacttgaggtcaggagttcgagaccagcctggccaacacagtgaaacctcatctctactgaaaatacaaaaattagccaggtgtggtggcgcacgcctgtagtcctggctactcaggaggctaaggcaggagaatcacttgaacttgggaggcggatgttgcagtaagccgagattgcaccactgcactccagcctgggtgacagagcgagactctgtctcaaaaaaataaataaaaaataaaaaaataaagcatcaagtatctggaggtaactggcatgcctcacctttatattttgcttctccaggttaaaaaataacccgtccctctacctgttcctcaggtggtgtggtctcaaggccccaccacctctgtagcatctcttggtggttaatatccctcttaaacttagaaagccatgagtactgtgaagatatcaggtgctttctcaagatgagcattcattcctggtcaccatggtgctgagagttcaccagtgaagtgttagaagcttctggagggcaggagcagaggcttgctgctgtctttctggagcagcaggcacaggcacagggtagccccatcatctcatcgggtcccaagatgccctctgaagctggatatgccaagctttgcaccggtggctggaggcctagcggggattccaccggaaatctggttctagagaatggtatattttgaattaaccactcaacaaatcataaagcaggattgtcagactcattacgggaaaagctgcactgaaaataatgccttaagtatgtgttgttgctgctggggatacaatcggtattagtggcttaaggggctcaggaaatttccatgagaccgtaacaaaggaacagccagcatttggtgggaacaatggaggatggacccttttctttcatcaatgaaaggagatctttcttattatttaaaaatttgcttctccaaacacccacttctccccctggtgtaccatgtcagagttactgaggaggttttaaaaaaaatcattaaacaacccccccaaaagagggctcaatgaggtctcattccgtggtaatgagctccaatttaacgccatcattatttctgacattaaaggcccgagaatagtgtcacatgcccagaagctatttttttttttttaaaccagctaatcccagaaataagaaactgccatgagggacagtgagtcagggcctgtaaaagtgctttaggagaggactgtggcaatagactgacctgagcgtgggaggcacagcctgcacaaggcccttagccaccttgggcggacaggcccagcttgtgcagtgactgtccagtgagtcattaagaccctaggttttggccagacgcggtggctcatgcctgtaattccagcactttgggaggccaaggcatgcagatgagttcaagactagcctggccaacatggtgaaaccccgtgtctactaaaaattagccagccatggtgatggacacctgtaatcccagctactcaggaggctcaggcagaactgcttgaacccaggaggcagaggttgcagtgagccaaggtcatgccactgcactccagtctggttgacagagtaaaactctgtctcaaaaaaaaaaaataagtctaggctttgtgttagattctaagtttgaggcttagctgtgctgcttgtgccaaaaccttatgactttagggaattttacttaagttcctcatgccttggtttggctcatctgtaaaatggaacccataatagtacctactaccaggtggaggcaaaattaaataggatgcagaacacagactctaacatatcaaagagaagaaaggaacctacaggatgatggacagggagggacatctggaagcaacagctgggctccaggcttagagatcaaccagtgccaaggggggcagatcagaaggctctagaagaactttcataagaagacaaaattagtagaatgcccaatatatctggatacattgagagatgatgcacacaaccggggaagacttcaggtatatgtcaatgacagaagactaagaaaagcaaaaacagaaccactgaaaacagagtcatttgggaaaagaagagtaaacagaatatactacatggctcagctaggctaaatattgatctgataaaaatgacaatatcacgatattggcaagatgggaattttatgagggttttttgaaggggaatttaaaagagagctgggccctcatttttcacagtgggaagtcagtagataatgcctagaaataaaaatcaagaaacagcagcaaggccaggcgcagtggctcatggctgtaatcccagcactttgggaggctgaggtgggtggttcacttgaggtcaggagttcaataccagcctggccaacatggtaaaaccccatctctacccaaaaacacaaaaatcagctgggtgtggtggggtgtgcctatagccccagctactcaggaggctgaggcacgggacccttgaaccctggaggtggaggctgcagtaagctgagatcacaccactgtactccagcctgggtgacagaatgagaccctgtctcaaaaaaaaaaaaaaaaaaaaaaaaagagtgaaaaagagaaatagcaacaaaagcattttattgagagatatggaggtaaagttctaaggaatcagtttaaagcactaaaagagtttatccataagggagtaggagctagataggggattttgggggagaaattatatatatttttgcaacaagctggaaggactatataaatctaaaaactgtgtatgtaagtaactttgataacagtaaaactaaataaaattcctattgaaatggaccccatcaattgatttcaccacgagttcctctggatttattaggattaagaccagatttagcagtttctctgttggctgtctcaaccttctaacagatgaaacgtcgaataaggcaggtcaagagcatttccagaagtgtatctttgttttttgtttttttgttttttgagacagtctcactctgttgcccaggctggagtgcagtggcctgatctctgctcaatgcaaactccacttctcaggttcaagtcattctcccgcctcagcctcctgagtagctgggattacaggcacctgccatgacccccagctaatttttgtatttttagtagagatggggtttcaccacattggccaggctggtcttgaacgcctgacctcaggtgacctgcccaccttggcttcccaaagtgctggggttacaggtatgagccaccatgcctggccaggaaagaagtttcattggctcacagctcagcatggctggctgggctcaagcaatccttccatctcagcctccccaaatgttgggattacagatgggagccattgtacccggcccttccttccaatttaagctgaatatttctttggtcaaatcagtatgttgcttgtcagtacattcttgtcagtctcaatgggctgatgactgggcccatgacatcccccatgatcactgacagtattttaccgttcctgatactgcagttcctggtcctcccctttcctccatacaaatgttacattcagtactcccaatctagacagtcgttcatatgctagttcctttgagatcaaaattatgaactcagatttgaagcagagatgagcacataacaaaggtatttgcgctgttcacaacttcaaagtcgctggcgagaaaatcaagttgctactggacgtatgcattccttctcacgtgaatcttccttctgatgctgtgtgctgtttcctagctctgatcacattgaataaactatgaaagttgggacctaatctccaaaacgagaggacaatggttcctgcaggaaaacacattctcttgggagtcaccatagtatccagtgggtaaaagcactgtttcaaaaggaaaaatgctagaaaacactgaagtgttcaattaagaacattaattctttagtggttttctacctgtatgccaacactacagatatcctattatatatatatatatctcatgtatatcatatatgtgatatatatgaatatatgatatatataagatatatataaaatatgtattatatattataaagtatatatatcatatatatcatatatgtgatatatgtatacatatatctgtatgaatctaaaaactgtgtatataagtaactttgataacagtaaaactaaataaaattcctatcgaaatggatcccatcaattgatttcaccaccagttcctctgatttattaggattaagaccagatttagcagtttctctgttggctgtctcaaccttctaacagataaaacgtcgaataaggcaggttaagagcgtttccagaagtgtatctttgttttctgttttttttttttttgagacagtctctgtctcatatctgatacatatttgatatatatatacatatttttctttttgagacagagtcttgctctgttgtccaggctggagtgcagtggtgcgatcttggcccactgcaacctccacctcctggttcaactgatttttgtgcctcatcctcccaagtagctaagattacaggtgccccctaccacgcccagctaattttttgtattttcagtagagatggggtatcatcatgttgaccaggctgcatttgaactcttagccacaagtgatccgcctgcctcggcctcccaaagtgctgggattacaggtgtgagccactgcacccagccctatttaatattttgaaataatactttacatgaacagagacagaaggacaaagatatgcttgtaatggtacagaaaaccctactgaaattataaaaactggtatggtaaataacttcctagattttatattaattgaggctttgacatggtcccaaagtaaattgaactctgtaccccttagataacattttcagtgtacttctatgtgccagacactgacctaagcatcttacatataccatattatgtgacattcttattaactcatttggcagataaggaaaccaaggcccagaagggtaaagacatttgccttgggattgaaagttcacattagtaaagccaggacttgaacccagctgtcatcccaaagaccatgctctttatcactagagcagtggttttcaataaggagtggttttgccccatagagaacatttggcaatatctggagacattttcagtggccatgcctggggctaggagtgcatctggaatccagggtagtctctagaggggagatgtcagggataatgccaaacatactacaatgcacaggacaccctcacaaaaaaggatcatctgggctgagcacagtggctcatgcctgtaatcccagcactttgggaggccgaggcaggtggatcacctctgtcaggagtttgagatgagcctggccaacatggagaaaccctgtctctactaaaaatacaaaaattagccaggtgtggaggcgcttgcctgtagtcccagctactcaggaggctgaggtaggagaatcacttgaacctgggaggcagaggttgcagtgagccgagatcacaccactgcactctagcctgggtgacaaagtgaggatctgtctccaaaaacacccccaaaaaccaatcatctggcccccatgccaagagggtcaccctgcaccgtgctctgcttgtttttctttaagaaattctgaactaattgcccattatcctgtccacagcatctagagttgtagctggcacatagtaggctgttgtctcctaactattagcaaatggattatttttctgaaattattaaagcccctatatggctacataaaaagacaccaattgtttttctttcataagtgattatgtgcctaatactttaaaaaggcctatagacttgaacctcaccacaggtgcttggaacaggggccctgatgtgtaaaactccccagggatggtatacaagtcccacgaatagaccctaattacttaccttaagtgcagatatataagacatctaccaatttgtttccccacacaccagttgtcccacaggactttgttaagtatgcttatatgtacatcttagagttatacttttaacaaggtttagaagaaaacaatgcttactatacacttcttgggttttcttttccctttgttattccataatcatcaccctacctggaataaataggccagggccttagaggaatgtagcaattctgttgaagttatgggaaagtggctgaaggacctaaatggaagatggggagttagaaaatggaaagacacaatattccctgttagcctcccggcgggcatctttctccactcctttctagtttgtatgatgggaagaggcttatgcggaggagaggacagagaattaggtcacacccatgataactgaagattggcttatttatgaatatcttgcacggtgcaagtataccatgtaggctcaaactggagaaggctgtattttaccctcctaacctccttctgcagctttaatgaaagttttcaaaggggaattgacatgtttaattgttaactagaagactcatttattttttttcattcattcattcaacacatactaagtgtgttagtctgttttcacactgctatgaagaactgcctgagactgggtaatttataaaggaaagagatttaactgactcacagttctacaaggctggaaaggaaacttacaatcatggcagaaggcaaaggggaagcaagtacatcttatatggcagcaggagagagagagacagaagggggaagtgtgccagactcttatcaaacaaccagatcttgtgagaactccctcactatcaagagaacagcatgggggaaaccaccaccatgatccaatcacctcccaccaggtccctccctcgacatgtaggggttacaattaaagatgagagttgggtggggacacagggccaaaccatatcactaagcaccagggtatcctcctgagtacacagatggcctacatttcctaacctcatttgtggtgaggtgtggccatgtggatgagttcttaccagcacagatgagcctaagtgacgccaactacttctccgcccagaccttaacactgatcctgtaggtggtggcaatgccccctgcagtgtggaagcagcataaggaaataaacctaagcggctctcttgtgagcaagaaattcacttctttgcttatccagctgctctatttggggacatctttgtcatagcctttgttacttacatggatgtctaatagcagtctatgcactcatggagttcataatctagacagacagtaaataccaaagataatcagggaggcctctctgaggaggtgacatttatgatgagacctgaagagtaaggattatcagccatgcaaagatctgggcgctcaggcagacagcaaaacaaatgcaaaggcagaaattaacttgtgtctgaggaatagaagagtggcatgactggaaggcagtgatggggtcagagggtcactgggtgaggttgagaggaggcagaggaagagtaagtggaggcagttctaagtgtgatgtgaagccactagggtgttttaaagtgggtataggcatgggtgtgtagagagagagggagagaaggaaagagatagtatttgatttgcatactgaagatcacctttggcgatggcatagaaaacagactgcaaggatcaagaatagaaatgagaaaagcgaagacagaatggcagtggttcagtgagcagtgatggtggcttggaccaggctattagcagtggggatgtgggaaagggctggattcagggatgcgtttggagagaaagtcaatggatctgactgacagattggaagtggagggtgaaaaacagttcttatcttgagcaggtgggcagtggtggtatttgttaagctgggcaagactttggggggtcttggaaatgggggggacatcaagaggcctgttttgttttcgcttttgtttcttttggagatggagtctccctctgccacccaggctggagtgcaatggcgcaatcttggctcactgcaacctctgcctcccaggttcaagtgatccttctgcctcagcctcctgagtagctgggattacaggtgtcggccaccatgcccggctaatttttatatttttagtaaagatggggtttcaccacgctggccaggcttgacttgaactcctgccctcaggtgatccacccacctaggcctcccatagtgctgggattacaggcgtgagccactgcacccagccaagaggtctgttttaaaagtgctaagcttgagatgcctgttagaggttgacatggagagtcgggggttcaggagagattactgaggagtcttcggcaaatcaacagaatttaaagccacagacctagatgtgtcctcttagggaaagggaaatgggagaaaaagaggagaagaccagggaaaaagtgtctagcagacatttaggcatcttctcaccagtgtctaggataaacaacacatcagcatttctagggaagtggggaagagcccgcactgttggtaattccaactggcaccatgagaatttctgtgagtgctggtgccggcctgcactggctcatgatagctgtttgttaaattttcaggagttgtgtgagccagttattaaatacagctattattgtggaagtcagggtggagcatttataacacagaaaccagcaaattatccataggaggatctctaaaaatttttgagagcctatctgtaagcacaccactggtccccacataatttgtgtccagacttatcagagaaatggcatgggatccccagatgccatctgactcatttcttacataagccgacccataagcacatcatttgtagtagatgatggcatgatcccattgtctgggaactcctataacactgtgacctccatccactgttgctctcttgccagcacaagtacacttataagtggcagtggttttttttgttttgttttgtttttttgagatggagtctcactcagttgcccaggctggagtgcagtggcacaatctcagctcagtgcaacctctgcctcctgggttcaagcaattctcctgtctcagcctcccaagtagctgggactacaggcatgcaccaccatgccccccgctaattttttttttttttttgtatttttagtagaatcggggtttcgccatgttggccaggccagtctcgaactcctgacctcaggtgatccagttgtcttggcctcccaaagtgctaagattacaggcctgagccactgtgcccggctggcagtggatcttaagcagccctacaaaaatgttaaagggaagggatgggaacctgagtatctggatttttgtggaattaatttttagaaaggtagaatattctctatactaaacaatagtcacaaacgatatgggaacttggggagttcctttcctctgaggcatgggtggaaacactgaggtaaatactttgccccatgaaagaaagcagaggggactccggtttcctggatattcgagacatctctccaaccttggggacacgcagcaccccatgatagcaagtttgttttttataatccttctttttcctccactcagtcttggtattctctctaccacacctatttcattgactctaagatgcgttttcacaaaggtgcaaatgggttgatgagtttattcaggagtattgacatgctacggtgcactggagcatgcagccaatctccctgcacgcttgagtgggccgtggttacctccactgcctccaacaggaatcgagtgctgttttgtctccatgctgggggactggagagatgtgtcattccagcatcaccctaattatgattttcagaagatgtagctgtctggatataacagggccatcaaaagtgtgtggaaagagtgtgtgtgtggtgtgtggagtgtggtgtgtggtgtgtgtgtgtgtgtgtgtgtgtgtgtctagatagcagagggtacacccccagaggctgggcttaagaatgaaatggagttattgcattactgcctgtgcaaagctaagcctgcatgcacagtaacagacgtactgacataggtgctcacacgcatatgtacaaaacccacgagctatcctgagcgaggcttttctttagagatgaatttagtgaatcagagaatgtcaaatctgtaaaaaaaaaaaaaaaaatcaccaaggttatcccacccaaagctttgttgttgttgttgtttcagatgaggaaactgaggcccagagaggttaagtgattgccctgaagccacacagctaaccagagaagatataagttcctgccttccttacttcccattctcataagcaagtttccgcatgaacaaggtggcaggtctgagcaaaatgctaaaactgtggccccattttgtttgtgcacatgtatgtgtgtacatgagctattggtgtgacgggagtttgcggggatattctctccctgttacatgttttcacatttcccacaagacgggaatgaaaaggaaggaagagctgaaccattccctcaggcaagtagatctgtggcaaacaaagagtccacagctcggtctccacgggggtcagtctgacttccttccctcagaagcatcccgggctacattttcatcttcgccgtcttccaatcttgcataatctataataatgtgattccaaatgcattttagcaaatgcaagatggaatgggactcccccggctgctcccgaacatctgatctaagaaacccgtaaggagctgcagtgaaaagttcactgatagaaaaaaacaaacaaacaaacagacatttgcctgtgtccctggttaggggcaaggcttttccgggttggtggctcttggtcatctttgttgtccttaaaaaagggataacgctgaggagctggcggttcacctttgctcttgtgtttaattgctgcaaaagccacttattaccttgtgttcttccgcagagggcacactgtctttcccagccaccaggcctgctggtgtttggcttctctacctgccccggaagccatccccgtcacctccgagtaattctgggtcacttccagggccaggtctgtctggctccggtacaggaaggccctcatgaaaggaagaagggcggaactgggatttttttttctttctttgaattttgcataaaattccgtccccagccacctaatgagaaaacatccatcatctatctttccctgggaatgtcggtggccattctgagctggtttgtggtcccgctcatctgtacgcaggcagggcttgtgaaattgcttttccctcagaaaaatatgttcatttccaccttcctcagatggccctcacaaatgaaagtgctttgtcatttttaatgcccagtgttccctttttcccgcactgtctccagtcacgatccagccgataaaacccacaggtacatttaaaacaaaaaacaaaaaacaaaacacacacacacacacacacacacacacacacacacctcaaaagcccagaggactgtcagattccactggtgtccccttgtgggttttcctggcacacagagcaaaaatggctgcaaggggaggttctctctctgttccctggaaatctccttgggccttgtgcagcatttggatggacacgcagcgacaggggacgtgctgaattctagataacagatgcctgccttaaaatggaggcacaaagcccagccctgtccccttggctggccggctctgagcatcctgagaattaacagaggtacatgtgctttataaaaactggaaagtgtactaaaaattcaaagttattattatttctaaaatgtctccagcctacgatttgtcataaacacctatcattctgcatagataattgggtaattgttcctcatgccagagggaacaaacgtctctctttgaaatgtgtgtggaggcttacacatagagagccctgttataacgagggtctgactccatagagatttgtagatgccaaaagactaacaataacctcctccaaaaaataactgcatccagcttttcataggcaagttagtaggaccacctgattccagcattttaaaagagtcaccctctatatggaaatgtggtcaaaatactagtccaggaaaggaacatgacagatttgttggccaaaacttatttcaaagcagaatctttgtaaaatatgatttttttcccacatatctgcatttcaagactgggttatctttgtttctttgtgattgttatttaaatacatattagttttaacttttcctaccttttcttgatcacaccatccgctgagttaaggatctgtaaacaaagcttgaattgagccaaaatgatctaacttccaaagggaacccttgtttcctcaggtaaacttgaacgtcttcattgatgatagagaaccttgcttctcaaataacctagcatgaagggcaacttggtagttgtttttgttgctaatatccaattccccatggcctgatacttttgtaaaatacataacagttgaattactagaaaaataaaatgtcgcttgaatgttgcagtcatgtcatatggctacaaaagtctttaaactcttaactctgaatttctctacttaacttgttgagaatccctgtcaaatggttaacagaccaggaacgacctgtggacccgctttgagtagcactgaggttgagacagctgtcctgccatcttacccacggtggctcattttccagctatgaaactgctcactccttaacttataagagtttgtcaatccaatgttttaataccttttttaaagcagggacaggtctgtatacaaagcctgcaagctaagtaatcagttgataactgagagggagggctgttaatgtcaatatgagttacacaaagcattgtccaagaataaatcaggaagttaccctaaggtacggcagagggaggggagggcttgggggtggctgtcgtacatatggaaaataaaaaaaaaaacattacagagaagtaattcttaacctgtattccataagacagtagattaagaggtaatagagagagctaacaccaggctggactaaagaactggaagcagagaacatacacaacagtgtaaataggcacacacacgtgtgtgcatgtgtacacgtgtgcatgtgtgtgcatgtgtgtgcacgtgtgggcgcacggtccacctggtgggctggctgattggaactgagtaaggaagggtggaaaaaaggttgagggagcattttcagaaagggggtccaatttatatccgttgcagtaattggtttgtttgtgtggagcaggaagaaggggcagtgggggacgtgatggagtgaaacaccgagggctgcgattcccctgcttgatgagttggagagaaattgttagtaaccaagactggtcccgcaggggttcgttaagtgactggccctccaccatatcctgtcatttccaacctggatgcatcaacattagcccgctttgcggtatgcaattgtgcatctgcacgggtgtgtgaaggcgcaggagcgtctgcgggccgggtctgtgtgcacgtttgtaccttttcttgtggatacagttaagttttccatgggaattagaatcatgaaggccacatgcaatttttttttaaaggcaaaaagcaaaaggtgctttcttactggaaacacaaatttgctgtgacacttcaaaagtaccgtggagttgaacaataggaaaactaagaaagggtctgaactgggcgggctggagggagctgagcactgaaaggctggccggtggcgaacacatccaaatggtaacttcttaagtcagccctgaaagggacagtgagcagtgtttgtctccggattgtgaggcctgtcaacccctgggagacaggggcccagaaactggagttcaggccaagagccaggaaggaaggatcggcaaatttgccaaatgtgcagactgcccacaatgtctgggtgctggtggcatttggagtcacggatgctctgtctttggatcttgggattttttttttccaggcgaaaatggaagaaagactcctgtggggaattttaagggtaggagtccctttgggaaccccataaattcagatcttagaaaagcactgaggaaaaaaaccaaaaatgctttttgcaccagtgggaactctgaggattcagtctcctaagtgctctgcctgtctgggttagccaaggatccagtttcaggggctgggggaaagctaatgccatctaaaggaggccagcccctcccaccccctcaacccacttagctcagtcctggacaaggctggactgtagcctctggacagaggatccccttaaggcacagaagagggctggacttcaacctctattctgtggtttgtaatggtttcctggaatgaacaatcaaaatgtaaaacctgcaagacatgaaagtgaccatctttgagtgctttttctacttcctaaaacagggatgcactctatctgcgcagaggaaaactcgtaggacctcctaggatgcatcttggctccaagttcgtgcagtgttattaggaaattacaagtctaagcagccgcaaagagaccgttaaatcacatcacctgcaggtttgcaaatatatgaagataggcagagctaattgccattattgttgttggtatcattattgttaatagatgccatctgttgatacttcacatcttatacatgtctcattttcatcttcattataagcatgtaacagaaaaaggcaagtactattattatccccgttttacgcataaggacaccaagtctctgagttcaggatgtccccgcgagcccagaccacctgagtccacagccatgctcttagcagcttgttttgctacccctccaagtcctgttaccatttcctaagtgtttcccaggtggaaggcccattcgaagcactttacatacattatctaattatctcatttggtcctcagagccacaaatcaagctaagcagactgcccaacctccaagcacttatgagcttgttgttcccacggagtcacatcatccttagaccatttgcaacggtccaaggtggcagagaaatcacttctgggcatgaatgtggtcattaccaatggccgtgatgggacctggggctgttgctcttcaaggctgatatgagcctctagataactcaggaaggaaacttttaatcctcatcattacaaccatcagtgttgttctgagcatcagcgaccaaagccggaaaggaaataaagaaggactttgagagtcatgtgtgttttgcaatgaaccaaaggcaaatggggctttcctgaattttttaaatttaggggccagaatggaaattattctgtttttttccacatctaccaagaaggactaaggcttagctgtactactttctacgatcctggctgatttttctttttcagtagaataacataaaaaaggaaggccagggtgctctccaaacagaacccagatctaatgaggggattttggagttgtttatatagcatgtctccttatctgtataaagcaaagaacatctccaggtattttcagtggattgatctcatcaagacacagatttattaaaaagaaacacagatagagggaaacaggccactgtaatttatacattagtttttttgttttttgttttttttttttaagaaataaaaactaactccaagttttttagtcattgcaatggggccctgcacatcacgtatgtaatgtaatgacagcttcagactagggatgcttttgatgcattattaaccataaaaaagacattaaataccaggctggaatgccatggggatgcatatttcactaggaattatttttcaatgtatgcttaaagtttattttggtaaacagatgactggaggctgtcagagccggagtaagatttatgttcatttggaatcttcttgaaaggagcggaaatgcctgggacttgtggaacacccacagcaaaatgtaaatcttttcttggccccagggaaggttggagagtgccacacaaacaattcctcctagggatgtgtggtttccaagcagcatcagcgtagatgcccgtaggggcacacgccgggtagagggaacacacattctatcgtctctaggaggagggagcagaacaaaaacatctggactgggaagccggcctcaggatgccccatcagatgcctgcgcatcagctgcaaagaacgccccgaactaattcctccgtttcacagtcacccccatgttggcaccaggagctgtttccttctgtgctgacacatttgtaaagcatttctggttgtggacgtagaacttattgaccatgtgggttttcctatcctttgtaaatgatggaggcatcactgcatccatctacaaagcccttccttggagcttctacagccccaggaaccgtcacagagttacagtcgaggcaggaccaatgggtacctttctgaaactgaagacaatttcagatgatcacagtgtgcacctttagggcctgcttctgcttctttactatttgatacttagtaagtttcatcctaaagacatacccattttggcagatactgacagcttcgcgtagctgctccaggctcaacaattcgtatggaatgctataaattctgtttaacatttgttacatagatacttagctacagattcagagccagatgggcacacctaacccatatgcatctgtaaaatactctcctgcccaaatcctgcctgtatctggaacactctgagtgctcagaagatgttactacaattttagggccgaaggatggtctatttcaggtcaatgatctgtgatttgcactaacagggtattagtggcatgaagatgtctgcaaaagaacagaaagaaagagttgggaatgtattttctttttgcagccttatcatcttgagctttggctggggctggtttatattatctggcgacattcccatttttaaatatggcactgaattagcctaggcactcatgtttcagtttcttagagtaacaattaattgaatcaaggttttggtgatgccctcctccaagggtggctgattctgtagcagcagttctcaaaagaaagggtgattttttcctgcagggcgtatttggcaatgtttacatatatttttggttgttacaacttgggagtgctagagatactcagtgggtggaggccaaggatgctgctaaacattctacactgcacaggacctccctacctccagccaccacggagaatgatccagcctcaaatgccagtcgtgcagaggttagaagccttgttctaagggactgtaaatgcggccgctatgctttgtgactaaaagtagctggaatgacagttcggctgtgtacaatccaaaaccgattgcattggaaaatgagggaagggcctgaatgctggttttccactgaatggtggttcaccccttgggtcctttgttccatggcctgtggtatgatatcatcaatgctctgagacccacacagcttggcagaggacacatcagtagtccaagaaggtgtcactgtgctcattccatggttggagaaatggaggtacagtacagttcaatgacttgcaagagaccacagcatgagggagtggcagggtcaggaacagaccactgagctttccacctttagtctcccacctcctaggctggtgttagaaccaggagatcacactgaacacacacactcgctccctcccttcctctcctgcatatagagatatagcaaatgcaggttaagttgactttaatctttaattcatacacaaggatgtgcagcacagagtgaaataaagagtaaactccagaggcagcaagttctgtaggtttggccagatcttccttttcaaagacagacagcctggggaatcgtgcaaatggtcttccactgccctcttagattctttttatggcaaaatgctggcttttatcaattcctaccccaacctctgattcctacaggctggggaaagcaaacagcagttggggaagtgcatccaccttctcttgtgatggcaacaggagacttggacccctggggaggccaagaggaggggagtgaaaaggggtgagctgcaggagtggatgggggtgggtgggggaagaagctctggttgcagatacctgtgaaacttgtttttttttttttgcttgggtggagggatttggcctgggacccaaacagatggttgttcattctgaccccctaataggcatttctgcattaaatgatatcagagtggacacaggagaaagaaaagtctattgttgtgtccaccataaaaatagacgtgtggatgaaatgatcttggagcagaatcgactagagagggtgaacttgggcagaagaaatcaactcggacaagccagagtccctgacaaggtcgtgaggtctcaagccaatgggatgacataaaaaggtatttggatgccaataactgtaaccagcagcagatgcagctgctactggttcctcattgacacgtccacccttccttttcatccccagtgcagtccagccaagaaataaaggcaacttggaatcccaacagctggaagtgctgcagttccatatgtgtcaattgtctggaagcctctgggctgggaatacttactcctttgggaatgagaggaacacgagcagagcggggctttggaaatccgttcccagctagctgaacttggggccctctaggcttgaagtcaggacagcggtggcctggacatttccagggagtggcccacagggttgggtcattggccagatgctgctgtgtgccagggtctgagcccttgctcagaaaagagacaggcatggctttgcatggaactcaggtgtttggtcctctcccatgggagaggaccacaagcggcatcaaattccagcgaggcaaccgaagttgtcctcatcttccagacctgctcaaactttatagacatgaacgccaaagattatcccaccccgccaaaaaaaatgttggctctctccccattcatttcaggatggccttgtgcaagggactcccactgttagtttaaacacttcgttctctgcattcaatccagggattcattcatttggtcaaggtcagccacagtaaagtagaagtgttaacttatctgctatattagcattcacccaaatgagcagcttacttgctaccaagccaactattaataccttttggtttatagcaccaaggtacagcattgcagagaataagccaggagaaaatgtcctgacctttaaaagcttagggttccctggagaccccagtgacatatctcagcaaggagaagagatatcctggctgagtcctcaaccctgggtgtggccaaagacaagaaaatatggtttcatttggtctggggacagccatgccttggatacatggtaagaaatcttgactcctggaacatgcttgcacctttccttttaagaactgttttcatgccccagttataacagcttttatccaaaagacaggcaataacaaatgctggcaaggatgtggagaaaaggaaacattgcataccactggtgggaatgtaaattagtacaaccactatggagaacagtttggaggttcttcaaaacgcgaaaaatagagctaccatatggtccagcaatcccactgctgggtataatccccaagaagggaaattagtatatcaaagaaatatctgtactctcatgtttattgcagcactgttcacaacagccaagatttggaagtgacctaagggtacatgacgaatggataaagaaaatgttgtacataacacaatggagtactattcaaccataaaaagaatgagatcctataatttgcagcaacatagatggaactgaaggacattatgtcaagtgaaatagccaggaacagaaagacaaacttcacatgttctcacctacttgtgggagctaaaaatgaacaacaattgaactcacggagataaagaaagagagtaggttgatggttaccagaggctgggaagggtagtgggtggggcaggggggtgggtgcaggtgggaagtggggatggttaatggctacaaaaatgtagttagatagaataaataagatctagtatttgacagcaccataaggtgactaaagtcaacaataatttattgtacattcaaaaataactgcaagaggcaggcatggtggctcacacctgtaatcccagcactttgggaggcccaggtgggtggatcacctgaggtcaggagtttgagaccagtctgaccaacatggtgaaaccccatctctactaaaaatacaaaaattagctaggcgtggtagcagctgcctgtaatgccagctactcaggaggctgaggcaggagaatcacttgaacccgggaggcagaggttgcagtgagccaagatcgcaccattgcactccagcctgggcaacacagagagactctgtctcaaaacaaaacaaatcaaaacaaaacaaaactacaagagtacgattgaattgtttgtaatacaaagaaaggctaaatgcatgaggtgatgggtaccccatttaccctgatgtggttattatgcattgtatgcctgtataaaagtgtcttatgtaccccaaaaatatatatataactactgtgtatccacaattaagaaaaaagtcttcagtttgtagccacagcccagatgagtgctgtcccatctcctgctcttggaccagtgtgatctgaaaggatgacatccagtagatggaggaaggacccaacaagagaggctgcatcctctgatgatactaatggtattcctaagaatgaagaatcacagcttttactatctactaagtataaaacatgtgtgttacacacacaagcatgattccatctccttcccgtaacaacccatgggtgatgggaaactaaagcacacagactcaaagtaacttgcccaggttcacagtggcaggtgcagaactacagcccagcaccgaataatcaaaatgccaggctataaatatccagttgtcatcccaccgacatagcacagagctctgatacataagatggatatgggttgctctcctagagctgccgatggcattgagcacttctgaatatgtcacggatggccaccaactggacagctttcatgctgctggaattttaaagacagggccctgtgacagagaatccgaagagactgggaacaaccacaagctagagttgacttcagaaatgctgatgtgaatttccgactttagaacctcagtccttggccaaaaatgtcctcaattttttgacttcttgtacagtgggatttaaagagattagcaattaaattttataggagatttgtgtattattgttaaaatttcatcagaaattggcacctgccctttgaaatatgcacataaactattccctgaagtatgatttttcaagagtgttgttgaacaaaaatctttatctgtgggaatacctttctgaaattttaatggccatcaaatgggaatatatgattctctccacaaaaattccatttatacttctttgttttttttcaggatcacattaagtgaaatatgaccatatacagcaaagatgtcatgggtaggacccataagtgtatctgtatgcctgtgagggtgttggggtataagtttaccttgttttaaaattttaaaattaactatcagcatataaaatccaggagatagtacataaaaattcagatcgatggcttctcttgaaaacatggaatattttgaaccctgggtggacatgtgactgaagcttagtgcaagctggtcctttttatgggacatgtaccctgcaggttactgccacgcccagcatccttactcctgttgtgtttcatgaatttctatggcctgcctgtctccttagacatttgagtgtgtgacctccagtctacatgatagcaggtgcctccatgtgtggaaataagtctttcttggttcctttgttgatgtatttagtttctattggggctaaaacttaaggaagagcaattaaagacctctaagacagataggcagtcttccaaagactttccaataaaaataaatatcagccaggatctgtggcttatgtctgtaatcccagcacttgggagagcgaggcaggtggatcacttgagcccaggagtttgagaccagcctgggtaacaagatgaaacccagtctttacaaaaaatgcaaaaattagccggacatagtggcgcacacctgtaatcccagctacctcaggaggctgagaagggaggatcatctgagcctgggaggtcaaggctacagtgagccataatcacgccacggcactccaccctgggcaacagagtgagagactgtttcaaaaaaaaaaaaaaaaaaaaaaagtaaatgtcagagaatgtgtttgtctcctgaagtccctgcactagtgcacactgtacccattccacctgaattgccatggcagaccagacccttgctcagtttgtcatggccatgttctttgtgcttccctcattcttgcttacagtagacaactccctcccctcccctccccttcctttccctccatcatccaccttatcctcttccatcccggcctcatactttgcctcagggcaaggtctgtagtgttaagactgccgatggcctgagagaagaggccgatgaacccctggggctgctattagtatcggactttagacacattacaagttaaataggcttttgtgggctggcgggagatacaaccaccatgcgtgatactgtttctgggggagtatttcacccaggttccgaacaacagacttaaaatgaacttctgcaacatcatagcctattagtacattggattcttccaaattctagaagataattgggctttcttatttgcaacgtgttttcttagggcaagatctatatctgtctctctgtgctacgctgttgaagagcaataatacagatgcatttatggatcttaacaggagcgatcaactcaccaactatagctaagggcccaccgtgtgcaaagtactgggggaaaaatgtatagaaagctgccttgcaggagttcacaatacagtgtgcgtgttgggcacgaaggtggaaatggggcaaatagatggattactggcgattatgaatgatatcagagaaggccacagagattcagaaaatagcaggactagagacattcttatgaagaagatggtttggaatgaaagtgaaaaaataggtaatagttcaagaggcccttgccatcaatgacgtgggattccccaggcattccagacacagaacagagcaaagaacagcacaggagtgagaaagttcaaaggaaacttgggaaacagaggggaggctggtttgggtgaaatgtgacctgtacataagggagtgaaggaggatgaggctggaagagtgagttgggactgtgttggagagggctctgggcaccttgcggaaggactgccatgtaattgaccccaagacatagcaggcctgcgtgtggacagattggagggcagtgagaccagatgtggaaacagcacttagaagctcctacaattagcaaaaggcaatcagtagctctatgctgggggctggggtggaggagagaggcaatcgaagtgagaacattgtggttttggggaaatctcaagaactctcccagatcttggtgctgatgatgtcatttatctaacaatattattctgatacagtcactaaaccatccatccatctatccatccactgaacaagtatttgcatacctaggggcattgttcatgttatgcatttgatttggaaatttttctacacgtatgtaatgagttcaaggtcaaagactggagaaaccaaatgttctaagatgatttgcccaagtaaaaatgctctgcatattataaacaatgtttctcaaattgtgatcattggattattagaatgaaggatactttaagaaaacaaagattcaatattcaaagtttttatgcctcccttggtaaatcccaacacccatacaaatgatcaaaggccctgacaagtcctgcagttaaaaacaaaagtaaacaaaaaaactgtttaacctttcgcagttcacactttgaccacaggactcttttactgaataatatctactaaccttccaagaaacacattatgaaaaatattgttacaaagtagtatataaacttaaggcatagaccttcaagtgtagttactccttttaggttacctctagctccaaccattacctgaaaggtaaatgaaagggaccataattcagggtataacccacacagagataatttctaccttttaaccatttattgctgcatcacagattatcgaccacctactatgtgccaggcactatgtatggaattcacagtacagcagtcactaagagatgtttgtccctgtctgtaaagaactaaacttacagtttaatcagtaacaccaaatcttcactacaaggtgggacaaattggccactcgttctcctaccctcactttccctgtgattctccaacttatatttaccaaagcagttttattacagtgatatttcaaaagttctttatttaaaaagggtaattaagaggtaggatcccactgggggaaatgagaggccaagatgagagaattgcttgagcccagaagtttgagaccagcctgagcaacatagggagacccccatctctacaaaaatttaaaataatccaccaggcatgggggcacgtgcctatggtcccagctgcttgtgaggctgaggtgggaagaacttgagcctgggaggttgaggctgcagtgagctgtgattgcgccaccgcactttagactgggtgatagagtgagatcccgtctgaaacaaaacaaaacaaaacaagaggctggatcccaaaccagtacattcctctattagccagcagaggtgagaacagactagctaggaaaggagtttcacaagaactggctcgaataaccccagctggggacaaattttgattttcctcatctctggattcttctctctctttaacaaagaccactacccatgatcaattcctgggtgtctagcccaatccagcattcacagttcattcctgggagccaaagttcccttttgtagttccaaatgtttctctctcagttttttattttatttttttaaaataatgaccgatgttctaaaatcagctagcaagataggcaaaataatcagtaatttctaattgtatatttaaaatatcaatacgaagtggttctgggctgcaaaccagaagaaacagacttggcttataagacattaagaaaatttttagtcttgaggtctgcatgttttgtgagctttatatagaggataaaagtgaaacttcagcttttaagccatgctgttaaaaattatatttacatccagtataattctgcaaccattaagccttaaatgggtattaagcctgattcaaagtaatgaaacagatggtggaaacacacactatggattcttcaatctggggagaaaagggctgattcatctgtttcaagggccaggcaaagataaaagacttcatcccaaatggagctgcttcctcctcaaaccttagcattccctccaatgtatttctccgtgtggaaagtattattaatgtcagtatccccagtgcttgtaaaagattcataggccatttcctccccttactgaattcccctgtctgtcccgtcaccgccccatgttcgttcatctcactgttgggcagtttggtgacgccagttgcagattccatcacaacccagctgcctgtcataggatcacagcattttagagctggaaggggcttagagatggcattttcagaagagaaaatggggctgggcacagtggctcatgcctgtaatcccagcactttgggaggccaaggttggtggatcacctgaggtcaggagttcaagactagcctggccaacatggtgaaaccccatctctactaaaaatacaaaaattagctgagtgaggtgatgggcacctgtaatcccagctactcgggaggctggggcaggagaatcgcttgaacccgggaggtggaggttgtgctgagccgagagataatgccattgcactccagcctggacaacaagagcaagactccatctcaaaaaaaaaaaaaaaacaaaaaacggaaaacaaacaaacaaaaaacagagagaaaacagaagctcaaaggacagtgacttgttcaaagtcacacagtgagcacagactgggatcactgtaggcatttttattcctttgcttgtcttctttctcctcttctttcccacttctgaaaatatttacagaatcctttatagggaccagggtgggaaattaggagaaattctacaaggtgagaataaaaatgttgtagacagtcagcccaaaggttgtgggagtgctgatgaataaaggtagatggaatgggaggactagaaaaccagtattggactcattcattatgaaaattaatttctaactttagggggaacatggaaaagtccctgtgaggataccacagtcataaatgtcgtaggcaagaccggtgctgccaggggtactcaatttagcagacgaaagttgagaagtcggccggacgcggtggctcacgcctgtaatcccagcactttgggaggccgaggcgggtggaccacgaggtcaggagatcgagaccatcctggctaacatggtgaaacccccgtctctactaaaaatacaaaaaattagccgggtgcggtggcgggcgcctgtagtcccagctaccagggaggctgaagcaggagaatggcgtgaactcgggaggcggagcctgcagtgagccgagatcgcgccactgcactccagcctgggcgacagagcgagactccgtctcaaacagaaaaaaaagcaagttgaggagtaggatattatcatcatctcaacgtacctcccaaaatatacttaacagtttcaaagggaaaaacagtaactttgcggcatgaaaacctggcagataccaccttacccaagtgaccaaagggactatcagttataagccaaactgacatcacgcaccccgcatataataccctgagaagggcacgtcacctctgctattgctgcccaaaacatacgcatgtcttcgatcaaatcatgagaaccttcctatacattctatccagtcatggagcaatactttttcaagtgtccaggtgtgaaaaacaagggaggactgagaggctgtcatagattaagggagctgaaggaaacacagctaaaagctgtcttacatttaggattgtggataggatccaagaaacaggacgtgagtgaaaacaccggtgaaatccaaatacaatctatactttggtattagtattgtacccattaattaagaaaaggaattttttcttttcttttttttttttttttttggagacagggtcttgctatgtcgcccagtttgtcttcaaactcctgggctcaagtgatcctcctgcctcagcctcctgagtacctaggattccaagtatgcaccaccatgcccagccgatttcctaattttgatagttgcaccacagttatctaggatttttatcattggggaagttgggtgaggaatacacagaaactctctgaacaatttttgcaaattttttgttgtctaaaataatttaaaaataattttttaaaaaggaaaaagaggctgggtgcggtggctcacgcctgtaatcccagtactagtactttgggaggctgaagcgggtggatcacgaggttgggatatcgagaccatcctggctaacacagtgaaaccccgtctctataaaaaataaaaaataaataaaaaaataaaaaattagccgggcatggtggcaggcgcctgtagtcccagctcctcgggaggctgaggcatgagaatggcgtgaacccaggaggcggagcttgcagtgagctgagatcgcgccactgcactccagcctgggcaacagagcgagactccatctcaaaaaaaaaaaaaaaaaaaaaaaaggaaaaagaaaaggctgtgggatgcaaggaaagacagtaagtcatgggatggagctataaagcacagcagctgaccattccttctagaaccttctaaatcctaaaagatggacagaggccactgggaactcgctatttcccttttgggttaatcagaacttgtacgttattatagccataacattcacaagttagataaacttctgagaataagccccagggcgtggaagggattaaggaagagtccgatttcctcatcagttgcagctggtagacggtggtaccaggacttctgttgagtgactttggggcagccgccctacaggctcaactcccagaagctacctggcccgatcacctggaatagggagtccccctgtcacgggaaaggatgagaagtgggtacccagggaaggagtggtggggggaagaggacatctttgttcaggctgtgtttgttctacatagtgtgtatatgtttctgacaatgaaatgtgttcttggaaatgtccccttcatttatagatgtatcactgcagagtatgtgtgagaaaaagaaagagacatgtcagaatcccacagacaacagcttagccctgccttccattatatatacaaagtgttgtgtacgttagtgatacatttgcagaaggggtgggaatgtggctttgtccgtatttccaaatgtaaaacaggtctcccatcccctctgtttggttgtggctgtttccttacagaatgaaaatactggcattggaggcactgttgccagaaacttgcttggcaaaacatttacattcctttgtacatatatataaacaaaatcacttcttccaatggatactttttcacgtcctccctgatttctgtggtaataatgaccacatttggctccaaacctggggatgtggtagagaaagccacctcccaattccagatcctgaaatctcgtggaagattaacatggacgtcaaactgacgttaccaatttaagggatttaaacactcagctctagagtaaacaaaatccagtggcaaggttttggacaacttcagcgacgtttgacaacacaacccagatgttggggagtgcaaaccttgtaaacgtaggctttccactgtgttctgtacaagcaagatgttgagtgagacagaccggctaatgaaggaaagaagtactgataattattgagtgacttttatggggcagatagtatgctaagtgcgccatagacactgtctcactcaccatttgcaatgaggtagctattatttattgatatggacatgaggctcagaaatctgcaatttgcctcacttggcaagtgacaacatcagtatttgactcatgtgagtgtgactttaaaacctttgctatttccagaagtcaacactgactgtatgtaacattcctttgcttaaaacctcccagtttctctcactgccactagatcagtgactgtctcagctcagcctttgatgccttggtggtggcccctgctgccccacagaactaaaagctatttacgtaaggctggggctctcttaaaaatgtggttccctcagtcttcccacctttgctagcatttactatatgccatatgattttttttttgagatggggtctcgctatgttgcccaggctggacttgaactgctgagctcaagccatcctcccacctgcctcagcctctcaaatagctgggatcataggtgcgcccctccgtgcccagctttggctatgtgatttcttcattcacaagtctgcctgggactccttgtccataagggtgttgatactttttgaatctaatgatactatgtgcttagtggttaatacctgcttcttgctgagtgaatgaatgagaattaacatatatatatatagatagataatttttttttttttctggagacagggtctcactctgtcacccaggctggagtccagaggcgtgatcacagatcactgaagtctcgacctcctgagctcaagtaatcctcccacctcagtcttccaagtacctgggactaaaggcatgcaccactactcctggctaattttttgtactttttctagggacagcgtttcactatgttgtccaggcttgtttcaaactcctgggctcaagccatcagcctgcctcaacctcctaaagtgctgacattacaggcatgagccactgtgcccagccaggaaatgtttcaaatacttgaggtaataaatatttttaaattttatataagattctgtgtaagtgctatgaatgttacaactcattgtgaataatttactaaagcagaattcctaaagattcatattagatagtatctaatggttttatttcagtggttctgagctggggttattttgacacccctgcccaggggacatctggcaacgtcttgagacatgtgggttatcaccactgcagggaaggcggcgtcgctggcattatcgggtagatgccagggattctgctaagcatcctacaatgccctagaaactccctccaatgccagtcctcccaaacaaagcgcatattgccaagacggaataaccctgctttgtttgatgtaatgacatggcatatacttgaaggcagtcaaactacggttcatttgtttttttgttttatttcagatttttgatgaaccaagctggctggtgtcgcctcagtttgtctaaattaccaaggaccgctggaatttccctgggaatatgtttcgggaaaggtcagaaactcttcagtcgtcttcacgcttccactcagtagcaacgtttttgcacactcattgactatcaactggttgtctatgactcaaattacataatgaatccagcacataaattatttactcagatttaatgccagcaactgttatctttgtatttttttcccctctgccagctaatctggctcatttcattggaattttggtcatgcccattctccttctgcactaaattaactccataacgtagtataaacagaacaagcttgtgtgtgatatgcttaactgttaatttacctaattaaactaattcaattaaatcatttacatctttttggtaacatgccagttgataccacagcagaagtgggatgtttcagaagatgattgttcagcaaatgaatggaaaaaaaaataaaaggaaaacaaaatgagacaaccgtccaaatctcttggcttgaaaattaaatgatactgaaaaaatgcagctttcacggggcactgtgattagatatttttctgaaatcaattttctctacaaattggtattttaacagagtgatcacaatctattgtacaaaatattttaaacactatttgtacattcacatatttggtatgtttaagtaaagtgtgcttgttcccacattaaggtgtgatttgtgaaatgttttgtgatgctaacaagacgtgaactgagcagattcttttgaatgaatttgcaaaataattttgctaaattacataaatatctttaggatacatccgtatttcatttatagtcatcgtctaaacatccataccatagtgataaatgtacaaaatgtacaacattttatgccagtaaaaatcaacagaaaaaaaagacaagaaattctaggcaggagaacctaaactgtcatctttgtggagctccataaacctcctgtttcatttgactgatacagaatctgcacttgtggcagaacctaggtttgttgatggatgggccaccctagtttcatctctccagggcttctgtctgggtgggggatgggtttgttggtcaggatttggttttctcttcaggagcacacatgcccaggacaaaacttgaggcaaagccctgccttgacttataatgagggaataaagccctagattgcatagaacttcagaaaagcctacatgaaacccacctagattcctccatctgagcaaaggcctacaagattccaggacaaatcacaacatacaataagacctggcacctgcttggagcttcctcatgcaaaaggtacatttcctctaccacgcttccggggcaaacaggcagcacaggttatcttctggatgttcttgctttctacctatttctactttaaatccaagcatctttttcttttcttctcccatttaagaagcccaagaagataattcatggaaataaaacaggatgttttcagaagatttttttttttttttctatttgggaggccacctctgcagatactttcctctgctcaacccttgaatggggtcatctgtctttacaaatcaatggctccagcatatcctaaacatcctgacaacagagctttggaggttggcaataaaatgtctgaaactaatcttcctcccaccactcatgctaaacttattcttttttagtaataccaattccctgaagtcaggggccaccctgtctatccatttcacagcccaagcacagtgactggcacacagaaaatgcataaattattgatttcatagttaacaaagaataaagagacttttccccaaatcaaagtcatttttctccccaaagcaactttcccttccaacttcccagaggtcagtggcctcatgacttcttagcacccagacttaggtctagatttactgcccaaagggtcaaatttccaaaggcattcacatttcctctcaaatactcatgtgcctccttcctctgcctctttgctctattccttcctcttaataattgcagtcatcctcccaactccctctaccacctatgtcattcccaatctccattgaatactatggatttgaaggaaactgtgaaacagacaatcctcctgggttagtttgcttgggcttccataacaaaatagctcaggctgtagaaattcattttctctgtgagaaagaaggctacaggttctgggagggtagacatctgagatcaaggtgttggcagggttggtttttcctggggcctctctccttggctgtcttctcattgtgtcttcaaatggtcttccctctgagtcctaatctccccttctttcttataagaatcccagtcaaattggatcaggccttaccattctaacttaattacctcttcaaagactccatccccaaatccagtcccattctgagatactgagggttaggacttcaacatatgattttttgcaggggctggggagggacaaaattcatcctataacaccaccctttgttattcaagagctgttagggaaaaaaaaatcagaattccttcaattttgctgagcattggacagacacagttttatagctagacgactaacatttcctcttttgctctcagagagtgttggagtcttggctgcagctgacaaaggtaactgttgcctcaactcccagttccccttcatccttttttgacttgccctagggtcttatcctccacattccaccacactgggtgctggtgagaccgggcagactgtgatctcatgcatttgtcagtgatgcgtttaggtctggtcatttgtcccaatggaaggaaagcctgctgaaggattctggggaaaagtttgctgttaagaggtttagaaattggctgggcacagtggctcatgcttgtaatcccagcactttgggaggccgaggcaggtagatcacctaaggtcaggagtttgagagcagcctggccagcatggcacaatcctgtctctactaagaatacaaaacttagccaggcgcagtggtgcacacctgtaattccagctactcagtgggctgaggcaggagaatcgcttgaacctgggaggtggaggttgcagtgagctgagatcacaccactgcactctagcttgtgagacagggtgagactccatctcaaaaaaaaaaaaaaaaagtgagagagatctagaaattgatgcttcctttgtatctctggacaatattgggtctctgtgagatgttaatttctgtgccaatattaccattcaaaggggacctgaaagaagggccagctaacacatcaaggagagcactatccggaagaaatggaaaaatttcttggtgacatcaatgagccactgaatccacccatctgagagcccaccctaccactacatttgttgtttggtgagacaaaactgtttcatattatttaagccactttgaaacagattcttactactttcaccccgaaagcatactgaccaatagaaaggcttcagaccacttactagtagtctctcactagtcatgcttcctgactcatttgtaaaacagaggtaatgatacttactctgtggcatcactgtgtaacttgagtgaaatctgtcatgcaaggtgcccaactcagtgcctcataaggagaaagtgtctgaaacacagaggccatttctagcttttgctcttccaggggcttctggtagcttgaacatggctcaccttgcaccttctgcatatgtactcacaagcagagcaactcaacaatctgggctactgatggttttgttcacagtacttcgggaggcccaggtgggaggttcacttgagtccaggagctcgagactggcctgggcaacgtagcaagaccctgtctctacaaaaaatgaaaaattggtgaggcatggtgaggcatggtggtccatgcttatagtctcagccgcttgggaggctgagatgggaggagcacttgagcccaggaggttgaggctgcagtgagctatgattgcgccactgcacttgagtctgggagacagagtgataccctgtgtcaaaaaaaaaaaaaaaaaaaaaaaagagaaagaaaagaaaaaaaagaactagtatgaactactgacttaaaagtaatcaccatctttcaccatctttttttgtttgtttgtttaaagcaaaagagttcgttattctatagaaatctccctttcctgaaattgttcactgggctggactttcttatctggagctttctaaagcaggacatgcccatgagggggtctgataactgggccaaagaccaccagcgggagtgcgtcttgcctgtccccaccctctcttcttctgtgtttctgtcactgcccttttcctgccctctctgccctgaccagtgcatagcacctaatatagtgctttccaatggaatgatcagcaagtacttcttgagcaaatgcttggctgcaggaagcactgtagcaggagggtggagagggagaagctggggaagtatattcctggcaagtactttgtagacatctatctctttggttatctctctccccagtcttgtgccttgggatgcgtgctgatgctggggccacttgcaggtacccagacagctcggcccttacagaatgattatagaaatacatacataggtaccttacacacctagcaatttatgaattgcttaatctatgccaagcataataccccaagttttataatctcatataatcgtcacaattctaagggcatgaaacctattttatagatgaaaatactaaggatccaagcgctaaagtgatttgtccaaggccttatggctggtatgtagaaaaagccaaaagtgaaaccagagcctaggtgtttatagccaggagttaatgggtttgatggctgttctatagtcagggcattgcaggaagactcaagggtatggcagatgggtcgagctgatggacccctctcgtgtgtgatggaacaaaagaagctctaggggaggaggcataatcatctggctgtgggcagatcatagagatcctggcactgtttatccatctgaaaaattagcacacagatatcagctatatccttctcttcagatcattgcgaaaatcagatgggtctaatctatcaaaccactaccagattaagggaccatatcttgttcactcttggaacacagtaagtgttcaataaatgagaaacccgtgaaagaaaaataaagcctacttccttaccattaaaaaaaaaatgcttctgcttctcctctgtcaacggtgatcctctttttttcactttttcttccttttgtgtcccccttcttccttccagccaacccatagcactcacccttgggccctggctggccacacctcagtgggtactaactggtgagtcccagctggtgtgcactgggccgcccatgagccctggacagcctggttgtgatggccagagctcactggtgacaaatgggctctctgtgcctgtgacctggtggggccaattaatcactgggaggtgctctttctgcattatatatggccaaaagcaccccttggagtcagggaggacaaagctttaggaggttttgtttgtttgtttgcaaactagagagacaaaaaggaggtgacaagggtagggggaggtttgagagagaaaaaagtaaaggtcaaaaactaaaatggagcaagaaaggtgataaatggcctgggctggagggtggctatcctgtttggcctcaggaaatcacattaatggggatcagtacagaactggtcagaattatgaaaaccattctcataatgacagagtttgaatgcagttctgtagccagagtacccaagaatgtcttcaaattataatcatagggtgtgtgtgtgcatgtgtgtgtgtgagagagagagccattcatgcgtacgtgcactgatgaagaaatatgtgtatgtgggaggtttgcaggaaaaaaaaatatgacggctgcatgagctgcatataaaccaacatgctattgagagatactcattacatctgtttttaatcacaacatgtaaatgtggggaaagcagtcactgcatactcaaaagatacaccttgaagattctttttgcatcctcagaaagtgccagaatctgctgtaagcaaaatctcagtgcaatccaagtcagtgccttttccttccccgagttctgcccacatgcataaagatgtcaacgtgttgattattctgattagacttttagtgtaatttacggggtccagtcattgtgcctgggtgtctggcctgcacttgctaccctgacgatgccatttttaaaatgtcagctcagccatgattcatggctgatgctggtgacattgctgctgacctgaaagagttaggcagcaatatttaattaaagcaaaaaaagaggagaagaagaacaagccaaaggaaagtagagggcaaaacctaaaaagaactaaattttgttgctggaaagatcagcatctccaaacaaggaagaggcactacaaatgcaatatattgtcacttatttgtggctctgtgtctacctatcatttgtgagtggtaaggtcatgtgtaatgagtgagacagttgtttgcatcccattcaccatcattctggggccctcattccctctctctgtggggatttgctaggaggtggagctatcactgcctctggcttttgtcctcactgtgtgtgtatcggcagcctgcctgccacccagctcgctaacggcagcagtacctgggcaccagctacctgctcccacccagatagcctcttcccagcttgcaaaaggccatgctcatttccaagcttctagctccaggatgctgtgcaagacctagggtgaaatgagtcctgtgccctgcacgttggtggtacaaatccagccctaccagcagcaacagtagccactgactagcattaagataggtacttggctggacaaagtgactcatgcttgtaatcctagcactttgggaggccgccgtgggcagaccacgaggtcaggagttcaagaccagcccggccaatatggtgaaaccctgtctctactaaaaaaaaaaaaaatacaaaaattagctgggcgtggtggcgcacgcctggagtcccagctactcgggaggctgaggcaggagaatcactggaacccgggaggcagaggttgcagtgagccaagattgtgtcactacactcctgcttgggcgacagagcgagactctgtctcaaaaagaaaaaaaaccgaaacaggtactgccccaggcctcgtgaatttatttaagtgggacacaaattatcccttagaacacacacacatgcatgcacacacgtagacacacacatattatttgggaggtctactaagccgggtccctttgccaggaatgaaaggacagaatttctcattaatgggaaggccacagtgagctgaggtttgagaaccagaaccagcctttgtccaggcctgcgggagccaggctattgtcttctaggttccccttccccagtgaccccagggtcgggggcacacatgccggccttgaactctccgtctgtctctcccaccatattaattactactccctttggtcaggctaagaaaacagcctcaactgcattaggactaattaagaagagtgagcttcccattctggcagcctgcatcggtccatgcaatgcacgagccaggaaggggccctgacaatcttattaccacagaagaaaacacctccccgcgctccctcgaacccccgacagtgagttcacctcttccattacaaatgcatttgcccccagccaccagccaccagcgaggacagcctgggtcagccaggcatgcagggtcgaggaatagccatgtttccttaaaccgaggggagttagcagagcaaatgcagggtcatgtccatttataactccatctgttgccttcctcctccctccccaccataaataaattaatagacagacagagagatagaataaatatggatcactacaagtcattatcccttaaacctgccacgctctccattgaagctcacacatttacaacctgctcaggagttgaatccaatcctctggattccagagggtctgaggcccttctataaggatctgaagacagtaattattggaactgtcttctctattgcgttcttcccgtcagcctcaccatgttaaatatccagtgaatactgcaggggcctccaacagactccagccactgcttgctcccattcttccttcacgaggccaccaaagtcatattctaaaggacatccaggtatgccactggcctggtttacacaacaccctgtggacccctccatgtctagaggaaaacccttagcatggtttacaggctctttacacctggggcagggccctccttcctttttcatcttttgtcaatttttataggccatatctagcaactctcccaatcaccctactctggggatagcagcacagaagttctatggttcaagagagcaaagtaggtaaagtaagctataggagagtgaagccgatagagtccagccttcccccatgcccaaggggacagctgctactcacctcctatcaaatgtcatttggaaataaagaccttcagatatatatataatttttatgagatggagtctcactttgttgcccaggctggagtgtagtggtgcaatctcgactcactgcaacctccgcctccagggttcaggcaattctcctgccttagcctcctgagtagctgggattacagatgcccgccaccatgcccggctgatttttggatttttagtagagatggggtttcatcatgttggccagactggtcttgaactcctggcctcaagtgattcgcctgtcctggcctcccaaagtgctgggatcacgggcatgagccaccgcaccaggccaagaccttcggatttttttaagccaatttttaaaaatgtaaaattgccagattttaaacgttgagaactaattaaaatttgaagatggaacaaaatatgtcgacccataggcccccggtgggaactctgctctctagtctggttgtccctaccaggctgctcacagctccctgggaaaaccatcctcgctcccccacagatggcttggggctctgccttccctgacttgtgtaattgatgagagccttctcttccactcttttctgttggttcgagacagggccttgctctgtcgcccaggctggagcgcagtagtgtgatctctgctcactgcagccttgacctgctgggctcaagcgatcctcctgcctcagcctcccaagtagctgggatataacatgcaccaccacacttggctaattaaaaaaatttttttttgtagagacagggtcttgctatgttgcccaggctggtctccaactcctggcctcaagtgatcctccctctttggcctctcaaagcactgggattacaggcacgggtcaccctgctggctctcctccactcaactcattacaacctgccatccactgccttggcttgaggttgccaggtacactagaatgcccagtgccatttgcatttcaattaacaatgaatccatttaattaaagaatgccctaaatattgcatcagacatacttaaactaaaaatgatgcaatatctaaaatttaaatgtatatgggtgtcctttatttcctccactaaacctggcaaagctacctcagctacaccacacccaccttacattctttctgggcactgttctaggtgctgaggacacagcaggaaacaaaacagatcaaaagaaaatccctttgcacatggcgcttctgcgggcagaagagagggtttcctcttctattccaacatcattttggctcaagagttataacaggagtaggaacaagaagcattgggttggagccctggctcttctgcctgtcatttgtgctgctgagcctgtgggggtattaatgtccccatcactgaaatggggcaacagtgcctttgctgcaggtcatgaacaggggaggtgacacatacacacttaggacaatgtctggcatgaagtaagtggccagtgcattgaaccaggtgacacatggcactatttcttaatcgtttccatttctgtgacccacttagcccaaaaagtccctcaaaggaagggatgttgcgctaattacctttgtgtttccagtgcccagcacattgttgggacatactggggacaaaatgggtcagctagtgggtcacaattgtgcctgctctagaacataaggtgtggatgttcactgtctccatagaagtaaagagaaatggaaatttgaagcaagttttgtgataaagaaggacaaacatctaattacagagaaagagtggatttctttttagcctgaattatgcaatttgtctattaaccctaaacggcattgacagaaaattcaccttgcttttcctttatacatgctaaggtagtctgtttctagggatactcttaaaaataaagcactctaatttttatgggaatctgtttttttgtattttttttttttatgtcagccaggcacggtggctcacgcctgtaatcccagcattttgggaggctgaggcgggcggatcacctgaggttgggagttcaagaccagcacgatcaatatggtaaaaccccatctctactaaaaatacaaaaattagccgggctatggtggcatgcacctgtgatctcagctactcagtaggctgaggcggcagaatcacttgaacccaggaggtgtacgttgcagtgcgccaagatcacaccactgcattccagcctgggtgacagagggagacgctgtctcaagaaaaaacagtcttctgattataaaagtacatatatattccataaatgttccattatttataaatttaattactgattgttagacatgcagttaatcccagtttttattatttagaataatgatgtaatgaatatcttttatatacaattccatgatttatttccttgggagagaaaatcccagcaatttggtcaaagggatgtactttgattacaatactggaaatgtattaagtacatggcccccaagaatcctcaaaccaagtgtaaggaggcaggcgatggccttcacgggacaagctggggtctcccagtagtgtcattggaggtgagtctctgtgtctggagaagcaactagaccttgggactctagtttcatccccgagattctcctccatttgacaaggggaatgtttgggtttgagtttatgaaggcagcgtgttgctctcttataccaagaggttcttcagaactgctgagttctgagttccgaggtcaccctgagcacaggggaaattttcatctttaaaataaaaatccgtctccgcctaggtatggatgaagatttctgtctaagcacaagaaatagagtctcgtggtcttcaaactttttacagtctcagagccttgttttcaaaagaaatttgatactagggatagcaaatgcatggtttctaggccattattctctcatcctgtacctactgattacagtgctctctctctcatacatccaagacttggccttggggtcttccacacagcaatctaggcagcccctattaggtggctggagttagcatataactccatttgatagactggatattgaaacagacaatataaagcagatcaattggagtgagactctttgacaaaggggtgaggagtccagagcccaacccacttccttcccctctgaaaagactcttgggaatcctatgtgatccactgatctagttgatctgttcttatccctccaaatcccagcacttcaagattcatgcattctgttattcacatatgaagagaatgtttcccatatgcaagagctgttgtttgtcacctcatgcctctttgccatgtaattcctgttcactggatcaaggtataagtagaagccattaagatacagaaagacccactgctgcacccacagcaatgtcagcatcagggactgagcagcagaaaccgtctgtgatcctaagagcatcttagaatcgctctgtgtgtttttcttcttcttttttttctaccttgggctgcaagaggctacacaaggctccggatagatgggttttattgaagtcatttcaagctcccctgcctccccacagctgacctgacagagacagttaagaatcatctaattaaaaacactgatcattgcagtaccaactagatcatattgagataatcactctactagctcccaacgaggtcctgctgagaataactcctggccaagccacaggagggagaggctggggcctcgccactgtcctaagagccctgctgtgtccctggctttctctcctggctggggggatggaagggacaggcaggactatttattcagctcaaggtcctccgtggagtagagcatctaggcaggtcggggcctgctgccatggagctgccactgagtattactatcactccagacagcggcatgtcccctgcaagagagatttgaaaccccacaagctcagccctccacccccttgttctcccagacttataaaaataggaagaacacatgttcccattagtcacttgcttgagggctgctgtggggtatatgcacgcagcctgtacactggaaccaaatttgaatatcatttgcatcttgcaggtagacaatagataccgcatcaaaaacatgcacagcaccccctcctcagcaaggcgcccaatgaggcagaccagatgacatttcctgggaacaaggactatcgtttataagttttcaaatccacttgataaggcccctcctggcaaccgacgcccaccccagctggagaggcattctgagaggcttttaattaaacttttgcttgccaagagcagtttgcatacacacagggggaccatgctcctaggggagccataaagcctgccactttctttgcctctgtgtgtccttaactctctggggttacgaggcagacgcccagcctgtactggcaatgatgcttctggaagggcctggggagtgagcctgcagcggcagacagagctgagcccactctgcggctgcacggtgcctactgggtgagccgtggcttcccggccgcctgggtgactcccagggcagtggccagagtaaaagccagagaggacgaggctgcactggggttatgtcatggcacagccagagggagaaagactggaaaagccttcagaccccacaggtggcttagttattgacttgcgtgtcccttctgggaggggggcgagctggaagaggaggcgtcctttgtggctctgacctcccttgacctgacctttgtaactctatcaggactagtggtcagtagttatcaactgtcaataaaccgcccaaacacacactgtaattcagaatacggggaggcccatctatttgctgatcgatcttggactcgaaagttgacaaaatgcagggtcccttgtcttcttatcataatattgaaaatatgtgctgcgacacattgaatgatctacacttctcgtgccccactcctggggcccttagtaaatacaagaggattgattgagatgaaaggtgaacgggaggtctgtggtgttcctctaaggaaaccaaagcccctgaagcagggactgaggactaattagtccatctcattaagtttatctactaaggtcctatggaaacaggctagggctaccctgccccagttatctgcttcatttaaaaacaatctgcatctgcttgaataactgaggcaaaaacagactttggaggctttaatgatgtattttaatagaaatttcaagttcctggcttctctccctacccctttccacttgactttgtgctgtgttgactcatctatggatggtgttttttttttgttgttgctttttcctgcagaaaacaacaatgtgtttttggaggtgatcagataacatcattgaggttgatctcaagatgtggaacagtgggctgggagtgctgggctggccttctgttctccagttgctgggacaatggtggaggtgaggaaggtcagtgacttcaacagtcctctaagtgggtctgactgaggtacccactcaaactgggaaaacaagcagcttggctgacgccgtccagtcagtggccggcatggctatttacacggggcattgcaagtaagagtcacacctgcctactagagtcgtggggtggattaaatgaatgaatacctctgcaatgcatcaatagtgcctggcaggaagtaaataggactcaatacatgttatcagtgatattatgatgttattaggattgtggaatcatcctcattattgtttgaactggctggctggctggctggctggcattgtgttcagctttcaggtgcacctaggcagagatttcccaggtcacacctgcatgatggattggcacaaaggaggtaaagtaggtttctcaggcttgggactcttgatattttgaaccaattcattcttttttgagacagagtttcgctcttgtcacctaagctggagtgcagtgatgcgatctcggctcactgcaacctccacctcccgggttcaagtgattctcctgcctcagcctcctaagtagctgggactacatgcgcccactaccaggcccagctaatttttggtatttttagtaaagatgggattttgccatgttgggcaggctggtctcgaactcctgacctcaggtgatctgcctgcctcggcctcccaaagtgctgggattacaggtgtgagccacagcgcctggcccaattcattctttgtggtggggctgttctgtactccgtagcaacttgtgtccttagatgccattagcacttctctcccctcatttgtgacaaccaaaattacctcccaggcattgtcaaatgttccctgaagggcaaaactgcccgggatgagcagctctgggataaagccatggtcaggagtcacagttcccatttcgtgtctcacctgctatcctagaaccaaggcctccactcaagttctcccctgttctgagttggggctcacaggtactcaccaatgagtcaccctcaggaccttaggaatctgctatttggggtcaggggtatctgctgctgaagcctgggcggcctctgcagacctcaagggcatcctgcctggtgtctgcaccagagccctgttacctgctgaggctcactgaatgggtggtgagttctcccacggcccagtgcactagggatggctgctgttttagtccgttttctcactgctgataaagacacacctgagactgggtaatttataaagaaaaagaggtagcccggcgcggtggctcacgcctgtaatctcaacactttgggaggccgaggtgggcaaatcacctgaggttgggagtttgaggccagcctgaccaacacggagaaaccctgtctctacaaaaaatagctggccatggtggcacatgcctgtaatcccagctgcttgggaggctgaggcaggagaatcgcttgagcctgggaggtggaggttgtggtaagccaagatcacaccattgcactccagcctgggcaacaagagtgaaactccgtctcaacaaaaaagaggtttaagggactcagagttccatgtggctggggaggcctcacaatcatggtggaaggtaaaagtcacgtcttacatggcagcagacaagagagaatgagaaccaagtgaaaggggtttccccttataaaaccatcagatgtcgtgagacatattcattaccaggagaacagtatgggagaaaccacccccacgattcagttatctcccaccaggtcccttccacaacacgtgggaattatgggagcacaattcaagatttaggtgcagacacagccaaaccgtatcagctacccacccactgccactgctaccagggttatcaagaagccatgaattctgctaccatcaactcaccaggacctccccttgctttggctgtgctgttctttgtgactttgatgcaaggaagccaggtgacatcctggctgaagtcaggggagggtggggtggggaatggcttccttcctgtttgtttgtctctatgctctggtagatggacaccaaagtgatcccgtcttctccctggatgaggcatagagcttcccaagaccctccagtgacacagactcccctgagttctaaatcacacctttcttccctccacagatgccttgaacttgattcaagctggtcttgcttctcttagattgaagcttcttcagttgtttggctagacaggctctggggaggcctggagctcagcagtctgcctgacaccgcaatctggaagctctgatgtgtaggaagcacacgacttcttacaaatagtagaaacttaattttggagtaatattaggatggtgcaaaagtaattgagggttttgccattattttcaaaggcaaaaaccgcaattgcttttgcaccaacctaataccgtattttgcagatgaaaaaacttagggccagagagattaaatgactggttcaaggtcacacaattaactagtaacaaaggcaaggacaaaatgctcagttccctttttggtgtctatatttaactagcaaactacaaaaagtattataccaattaactaattttaggaaagggattttgtataacatgcctttttatctgacattggaatagggggttttcatatgttattgtggtgggaaattgaagcgtatcccttcatgcctcaaagcattatttttattttaaatattttcaatgaaatattcctaagacacattaaatgagactcccccaaagatttttacctcatcagtattagtgtgtgcattttgtgttacatccttttcttcctatagaagacatttccccccattacttttgacatttacatttcattccaaatagtcaaaattactatatataatttctacataaatgacataattattattattggtattttcaccaacaagtctatgtttactagtatgtggaggctaaaactgtttccaagtgggaaatattaatcaaaagaaagtcaaatctcgctattttccaggtctgccctgtttgcaaagtttccccattatgcatgaatgcgttttaagttttcaaaatatttgcaaaccaaaatggtccttgcaaactcttctgtagtctttcttatcatcatgctactttctgaagccattggacaccagctgtaataaggatgatattctctttcaacatcagtgttcaactttttacttggcatctttttcttgagttgggtgttctaatagagtttgatttgaaagtcaagtggttctgggatcgctctaaacctaaaaaaaaaaatggcaaatgtgggtccatcaattttatgtccaaggcagaggaatgtcaaaagtgtatttgcctaactctctggttccagtttatcgctctctcccctgcctgcaactcgtagctccagagaatttcagctcatcaagaaaaagtacagaataaggcttgatgacattatcacaaagtcagattaacagcaaatggaggaaaacaaaaatgggctcttccctggtagagatgtttctctgcagaagggtggatgctgataatgcagtcactgggataagtccttcaatcactatgaactcataatggcccaaatgcaatcttgggcatttgaaccaaagcaacaaaaatcagaaagagagagcatgtgaagcaagttacaaaacacacataactagataaaagaaataatcatccaaatgtattttgaactgtaacgcattaatacttttccatgttgacagggaaaaacaataaacatcaaatgcaagttatattacgcatctatgcattgcctctggattgtacaaagttcaagaaagaagcaaaattcttgatatagtgataaagtagaggaataatcacattaatgataacccttaattattattactaaatttgtgttaaattagaatttcagaacctccaaactctttccttattttcagcatcctcttgaaaatttgagaataaaatgtgtggtaattgccccaacaattttctttttggaaacttcctacctacctagagagtgacagtgttttccaatggagagaaaatcagactcacaaaatagcaagagaagcgacagccaggaccagagacaaaggtgacagaggcccaaagcagtgaagccagcagttcccattgcactgagagtgcaaacctgtgagtgatagaatgccaaaaaggaaaggatggagatttggacaagagcagcacatctgtctcagaccatcacaggatacaacctggggggtttttgccttcctccctaaaccaaagcaaattaatagaacctagctttctctttcctggaaaactctctgagggtctagtgtcagcaatagaggcggggtgagaaatccatcagctgtgttacttgctagaaagttagaagagtcagccggcagaagggtgatgctgaccgggcttcttagttgaacagactgttgaatgatgaaacacagtttggaatattaaaagagccacctgggagatggattagtggctctgttttttcatgccagctttgttcatctgattttgctacctttgagctcagcgtgctattgcaactgaccttcatcttgagatgaagtgcgcgtttaggaatcacggacatggaatcctccagcccagtgtatttggacctctgcttgtgccaaagaacaactaaatgcaaaatgcatactatgcatgagggaaatcactgagctgcttaccgatgctacactctttcactccctgtgtgatgtatgaaaagcagactgcaattatataattagactgaatatacatttttcccattagtgtttatttttgttgccagtcagattgcctcctggaaaatggaggctgttagtccacgtggtcatccctccttcccccctttcaagatgttttgctgatctgctttgatttctttttagcagcctgctgattcttctctttacgggtgctccttggagtttgaggggctcagaggtgtgtggattgctgaaattggacacatgtggcatatttgccttgaaaggctgaggcttgtataaagaggcccctggcagctgactgtcagtggggcaggaaggggagagggacaaaaaaaaaaaaaaaaaaaaaaacacaaaaaaaaaaacaaggagaagggccaaggcttcaaaagaggttacggtgtaggcacggggttgagatggaggaacacgcatggctgttagcagtcaagtgcgttgttcacagtacatgggaactaagtgagggttcattgatggaaacagtacacaatttggaggaataaccacagagtatttactgaactgccaaactgcctggcagcaccccatctgaccatccaatgactttcccagaagtgcaaatcagaaagtcaataagacacctccagtttccaaattctatctcattgcacataaactgaaagtctcaacaatcaataccgtgttactgaattacaatcagaattcagtggagcaacatccagacaaacgagtgtgtccaagaggcatttgagtccatgggtgaactccagaaattttacatgggatgaggtgatcagaccaccaatttgggagacagaaaacgaacacaagacagaaaaactgtagtcaatctgcttttttgaaaaatagacccatttggcaccaattaaccattcccatttctccgtgcctgccacggaaagtctccagaagctccgactttgtgttaatttcatcagcttcatttctgacagattgagagttggatttgtaagttggaaatagctactattgattcacagtggtgcctgcctctacctaccttagtaatggttccaacgagatctatgcagctaattccaattcaccagccactattttggaagaagatgaacattttcaggacctaagggaaccatcatggccagcctttcaaatggctttgaaaaaatccatcagtctctcaaaatctgtttagctgaacaaattcccccagctcccatgtgtataaacaccaccactctgttttcctatcatctgccccttcctctttattgctctcatattagtagattaaaagatcagaagtgccagcttttagcaaatagattcatctttagtcacaaacagatttccatgagaatgaacactaagttattagggaagagagataagcacattatttgtattttaagcttgctgtctgatttctgtttggcatgccctgatttcttttaagcactgggaacacgttcattttccaggtttatataggggttgttacatatctagagtgccatttagaggattactaatttactaaatggtaccccagtgccctgaaagagttaattcttttccaagagataagcaatttattttctatttagcagcaggataaggcccactgcttacaaatggactatgagccccttagagagagggagagagagatgctgtaaaaataaagggtataataattacaattattgtaatataatgtcaatccatggtgttatttttatacattccccctcctaacctttgtctaaaagaccagatcaacatcctgaactccctgtcatttttgcatgtgtctttgaaaaaccagatgccaagagatgtgctgtatcctttggtaaaagagcccatccagccaaccaatcaatcaacagatgttccctaaacactgtaaccaaacagcaagcacagcccaaaacctgcctcccaagagcttccaatttagttggggtaataatgattcacaagcaaactccaagccaggggtaacgacgcataccaataggaagttcacgcaagtccagctcagaggagagagaaatcagccaccctataaagcagccatcgccaaccaccctgagctgggagtcagtgacaacatgtatcttctccttggttcaaattccagctctgccatttcctagatgagtaattttcatcaagttacttaccctctctgagtctcagtgtcttggaaaaccattgacttgaaatgtggggaagattcagcaaagtcaaatctgcaaaactactttgtaaactgaaatgtgctacagaagcacaaatacaaaaagcctccctgaaacgtgtaccgttttgagaaaaatgaaaatggtggaatgcgacatcgtgtgcggatgagaattttctcaacagttagtgtcttgggattcactcttaacaggactccaggtctctccccttctccagagagacctgggtcaggcaggcaggcaatgatggctctcagtaccaagacctgaagaagggagggtgggtgtgtttacagatgaccagaatgaaagaaatgttagggagctgagacaagtctctcccaagagaaggcaaagggaaggaggagcctggaagggaaaggacattcatgttagtttgcaggtggaggctagaagtccgagatcaaggtgttggcagggttggtctcttctgaggcctctctccttcttatatagatgaaccttttctccttgcatctttgtactgtctttcctttgtccacatcagtatcccatttcctctttttttttttttctgagacagggtcttgctctactgcccaggctggagtgctgtagcacgatcatagctcactgcagccttaaattcctaggctcaaggaatcttttttaaattaaaaaaaaatgtgaacaatatctttagtatcttttgtgtgcgtagttaaccatgtaagtgaaaaaaccccatgagatgacataggtgattataatagaaaagtggaaaaacaactagtgtctcagtattgaattccgaatagaattcccagtatatggtaatcttaaaagagacctgtttcttcaggtgagtagctgacccacctcagggccatgcccctcttctctttcctcacagccttaattttttgccaaaagggccagatttgaataaaggggagcaccatgagcgcaggatccaggcataagggctgctgtctgttgggctttggcaatgggtgtttgggaaattcttgggctcaaagaatttgaggctgcagtgagttccacctcagcctcccgagcagctacagacatgtgccacctaacccggctaattttttattttatttattttgtagagacggggtctcaccatgttgcccaagctgtccaatttcctcttcttctaaggacaccagtgatattggattagggcccaccctaacaacttcattttaactttattacccatttaaagatcctatctctgaatccagtcatgttctgaggtatggggattagaatttcaacacatgacttttcagagggcagaattcagcccagaacaacatgtaaattcatggctggatctgaagctttctttatatgacaataacagaaagaagggaaagaaataaatttgcaagcatggggagcagcccaaatgtttatgacatacttgtaaagatttgaagagcaagaaaacagctttgtggatggaagttacggagatgtgtgtctgtgtgtacatttttcttaaaaaatagacaattcccactcagagaataatcagagttcccggacatgataacgatgtacaacttattgcctagatctttcatgcaaagtttttgcaaaagatgatagtttcttctctgaaagtctcctccaatggacacaccacaagatcccttggagatccacggtgatcatttatcactttgcctgacaaaaagttattccttatgtcttacccaaatctcttgctaatggaagccaaaggtcagcattttcagccttatgactttggtgcattccttctctttcccattccctgcaaatctattttcctccttccctccttctctccctttctctctctatggatatggagaataatgattcaaaaatatccacataaaattccaccatatatttagccagttaagttactccttggctttttttctttttttggagacagtctagctctgttgcccaggctggagtgcagtggcgtgatcacaactcactgcagcctctacctcctgggctcaggtgatcctcccacctgagcctcacaagtagctgggactacaggtgtgtgccaccatgcccagctaatttttttattttctttataataaaatatttgtattatttatgatgcccaggctggtcttgaattactgggcccaaggaaccatcccaccttggcctcccaaagtgctgggattacaggcgtgagccaccacgccaagtccttcgctttctcttggtcaaataaatattacacattctcccaccactgccacctgatatcctagatttagcttttcctcaataaaatattagacaaaatactcctacattttaaaataatgatttctagtatggataattttttcaagtcccatgaagtgaacaagctgctgttccctctgccatgaatatacacagagctctgatcccttgggtgggacttctgaggtacacttgccttttaaaatagaatattccgtataaacactttactgtgcaaaacagctgatcagaatccctggcctgtattgtatctaaaatgaccatttttctctaccatttctctctaccttattcaatgagtctggaaatcttttaagtttttttcccttagatttaatgtaatttgccactttttaaccacaaggtcagatagttcacacagcataaatgggatgcatttgtaagtctccattcagatatatgacatatacagcagccaaaagttatgctccttctaatgttaaaatcagtagaatatctttataaaaggacattacttgaaagttgaattccaggtgagcacatttatgtgagtggcctccagaaaacatgttctctctttggtgcatgtcagatagcaactgatggggatgcaactgagcaacactcaaagctctcaagtgaagtgcagcacctgtgcagcatgcaacaccatgcatgtttattctgtatgtgccacctgacctgtgctcacctcttagaaaaatctattcatggccgggtgcggtggctcacgcctgtaatcccaacgctttgggaggctgaggcaggtggatcatgagggcaggagattgagaccatcctggctaacatggtgaaactccatctatactaaaaaaaaaaaaaaaaaaaaaaaaaacaaattagccaggtgtggtgacaggggcctatagtcccagctactcaggaggctgaggcaggagaattgcttgaacccgggaggcggaggttacagtgagcggagattgcgccattgcacttcagcctgggtgacagaacgagactgtctgaaaaattttaaaaaaaatcttttcatatacaatgaatatagatgtatatatgtagttctgtatatgtatatacataattcgaatatataattcatgtgtatgtatgtatacatatgtgtatatgtgtgtatatgtatgtatatatgtgtgtatatatatatgtatatgtatgtgtgtgtgtgtatatgtatgggggggagagagagagagcatccatggttttcccagttttattgaccaaaatagcaccccttcaccatttttcaggcctcccaagatatttcccctgactttttcattggatttaaagggattttataaccatatcaattagaagggatcaatggtcaaggtctctacttgttatcaagcaggatagttccaaatggaactatctgagcagccctgagaagatcttcctgcctcccaggcctgctctacccagacgcaagatgcctgaaattcacaatcacatagtgtgccccagcataggggaaaaaatggtaaaatgttcctctggatttgatcacttcaggtcacagaaacccaacttccaacttctggagtctcattcattgagagctttgaccttctgaggctgctgcactgcctgtgcctgcggtaggcaggaagtaagagggaattaacacctgggagcaggtgtccaaatgcacagcagggttagtgtgtaaataaaatacaccagctccctttcccctgaggtggaataactgtgaggtgtgagttctacactcttccatgagttctgtcttgaaatgaagttcctgttgcccacagttgaaacttgctggataatgttctctttatgatcatccttctcttttcttgtttgttcttatgcttctctcagttcctgggatcaccttacaaataaatgaattttacttgaatactttcctgaggatctgtttctgaaatgaagacaatgcactcattcatttggcatagcctcagtaacacaaagttatggtctattaaggtgtggaatcttaagtctgagggggaaatggtggagtacatttggatcacagaatcttcctgctctggaacatggatggagctggaggccattgtattagtcctttctcatgctgctatgaagaaatacccaagactgggtaatctataaagaaaagaagcttaattgactcacagttcctcagggctggggaggcctcaggaaacttacaatcatggtggaaggggaaagaaacgtccttcttcacatggtggcaggagggagaagtgcagagtgaagctggggaaagaaccttataaaaccatcagatctcataaaagaacccactgactatggtgagaacagcatggggaaacctccccagtgatctaatcatctcccacaaggtccctcccccaacacgtgaggattacagtttggattacaattcaaaatgagatttgagtgggaatacagagccagaccatatcagccattatccttagcaaactaacacaggaatagaaaaccaagtgctgcatgttctcacttataagtgggagctaaatgatgagaactcataaacacatagaggggaacaacatatactggggcctaccggagagtagtgggtgaaaggagggagagaatcagcaaaaatcaaccatgggtactagacttaatacccaggtgatgaaataatctgtataacaaacccccatgacacaagtttacctatataataaacctgcacatgtacccctgaacttaaaagtaaaacaaaaaaggctgggcacggtggctcacacctgtaatcccagcactttaggaggccgaggtgggtggatcatgaggtcaggagatcgagaccatcctggctaacacagtgaaacaccatctctactaaaaatacaaaaaaatgagccaggcgtggtggtgggcacctgtagtcccagctactcgggaggctgaggcaggagaatggcatgaacccgggatgcggagcttgcagtcagccgagatcacgccactgcactccagcctgggcaacagagcaagactccatctcaaaaaaaaaaaaaaaaatgtaaaacacaaaaacctctctgctccaacatctaataaaaggaacaagaagtagtgaaaaaaatcaggaaaacaccagcaacagtcaaacaaagaaaatggtagaactacaagccataatcttcaaaaaaagtcagcttgggaagagtaggacaatgattttggtgtaccacaacgctgcttttaaccataccctgaatcccagaatgagtagaaagaagtaaagaaaatacttagaatgttccctgaataccccacagttcggagaaaagcaagccaaggggtgtataggcatcttgggtggagtcaggaacataatttcaagattagaagctctctacctcttgctagaggcaggaacattgcctctataaggacatttaacagaatttcatgaaaaggagcagagtccctggttctgagacacagcccatcagagcaactcttcccactaaagacccaatacagacaacagatagaacacattaaactgctgctaagaggaaagaagggtctcaggtaaagcaggaagttggtcaagaagaatttatttaatatctgttagtacagaggtctacacggagctctacatattaagcaagaacaaaataaataacagcatgaagggaactctatttttaataatggcaaacttgtcctctcagactaaagctttgctgaaaacaacttcatcatgctgtaaaaaatagtaaaaacaccttaaaagcattgaggagttgatgtgaggtaaaggagttggtcaaactgaagggcctgctagaaccctgaaagaaaagaacaggagaaacattctttatccacaagcagtcgccaataaggacatttgccaaatcagcacatttggatgttggttttgacagccttgctgtgtgtttgtgggggcagggggcaggggcagatattaatgctcagagcccatccagggtaacgaatctagtaagaaacttcttcacattaagccaggatgccaaaagattatacattaaggttgaggataataactttaaaaagggaatgaggtatacaaaagagatgaaacacccatctgggagaaaatacaacccaagggaaaacaactatcttttttagtactatgccgtagaatagttaaatatggcacacatttaccaaaatacaaactaagtggtaagctattaaagtaacataatgatttttaaaaagactttggagcttagggaaaaaactgcggactaaaatgtcattatagaactaataaataaattagcacagatagtatgaagtagacaagactgaaaatagaaaaactgctacagggcaaaggcttgagaaagtctttagtgaacgaaaaggaaaagataaaaaataaggaaggtaatagaaaaagaaaataatagatgttcctggagtagagactgcgacagaaaaaaatcatatataagagaaacatgaatgtgccttaaaaggggaaggtgtatatttatatacgtgtgtgtgtgtgtgtgtgtgtgtgtgtgtgtgtgtatcttcctcttttaaggcacattcattttttcctatatatgaattttttctgtctattgcattctctattcacagtacattctatgagaaactaatatgaattttttgatcctgagtatatcttaaagaacaaagaaaaaattctgtatttattcagaaagaaaactcatgtactctataaaaggaaatttagataagccacagtcttttccataacatccaaaagacaagaaagccatatttacaaggttctaaagaacaaggaagtatgtttcatagaatataatgtctagtcaggttcatgtttgaatataattgcaacactgaaatattctcaaactcggagtatgacacctatgagtccatgtattaatcaaacaaaatataacaactgtgcagttaaaggacagtatccagtactgtgagacaatggacaaaggtctaacacattttgagggaaagaaagtgtgattcctcaaattttatacccagctaatgtgtcctttcatttattcatttattcttgtgtgtttatttttattttattttctatgccttcacagtgcaccttgagtataaaggtaatagacattcttaggcatgcgcaagaaattagaatagagcatctaacgatcttctaaaagtcttcttaaaaacaagctgggcatagtggtttgtggctggagtcccagctactcagaaggctgaggcgggaggattgcttgaggccagaagttagagatcagcctgggcaacatagcaagaccccatctcaaaaaataacaacaacaacaataatataaactcttcttaaaaataaaattcgcctaataaaggtaaataaaaaacaatgaagaacatgaatctaaaaaacttgagcacttaattatttaatatagaagtataaaatatgacaaaatgaatgtggcttgagaacaagatgacaaatattacaaaccttgatgaagtaaaacaataactagtaaaaggaggtaagggaaggaaattgagtagctgtgtgctaattttctcatcttttaagcaaggagtcagtcaatattgtctaatactgaagcatgaagttaaagtaatcgatctagaaaaaggttttctccattttttttctcttaatcatagattgtttcagaactatattctggcaaaaaaaaatgttttcttctgaggatcagaaatgcttcaatttcaagtctatattttttgttaaattctaacctaacaatgtctacccattaaatgcaatacttctgatatttgtcatgcataaccctattttaaaatatttaaataaaaattgtacatattcaaggtgtacaatgtgataatttgatatacatatacactgtgtactgattaccacagccaaattaattaacatatctatcaccacctatagttaccattactgtgtgtgtttgctgggggtgaaggtaccttaaatccactcctatcaaacttcaggtaaacaacacagtgtttttcattacagtcttcataatccctttttaaaaatctgtttttcttaacctcattgaatcttttattctctgtatctgtctcactgttctcttttctttcacgtattcatggtaaacaaatgcttagacattcaacagatttgaaagacttttttaggtggtagaagttttgatgaaattttgctttctttgtattctaccacttttaattttatgtagcggacatgtgtcatttttataaaaaaaaagtcattattccataaaagaaaaaatataggcttttaacacgtgtttgtggttttcatcttcgtgtttttcataattttgcttatggtatcaaacgaaagtagcaatcacttgactttactacatttttaaaaactctgctgttttctttagaagagctagcctcttggaaactgatgcttcttttctcttgatgctgccagatccctaactccgaatctttcatattttaatcctcaaggtttcctgaacatgtcgaaggagaactcaccaatgcctgcatgcatttgcagattaacagcttctgccattagcaaattggaaatcccttccctcatctttcttacagggggagtctttttctcctaatagtactatgattcccatttctgcattttcttattaatgtagtgtatagagcatttttatttttcttggctgctttagctttctgttgagcttcatgagtattaaatggaatggcttatctgagggaacaaagcaaagcaaaaactctactttcaactaatgggaagacggatctttaatacagaagcaagacactggtaggcaaacagtacatgggtcatgctctgtgttccactaagtcataaggctctcatgaggccacaggatacatgtttggagcaatgatgctgcctcagtgggtgagatgagatcagtcaagggcctgcagcttctgatttgaaaacaacaggcacctgatctgaactggggtgttcccagaatgtgacccaagctttcagcttacactaggggatatactagacttggtaagtggaaggacacaggccagatccatcaaaaaatgctttacaatgaagggcaactaagaatcgagagcccctacgatgcaattcctttagactacttgttacttgaattgaggtgactattagtggcaccaatcaatgaaaattttttctccctaatattttgtaaaatctgtggcttctcctgtagccagtatctgaaggcatctagtcaacgcactaaatatcctgttaacattgataagcatccttatttctaattaccagatgaatatatgaaggcattcttgttcaagaaagcatcggtatttttgctactactgaacaattaacatagttgatggagtgagccacctgcactctgggtgttttaagcatttttctaaattattattttggttattactactctctgagtaagatttttgcctcttttaatatttctgttaactgggaaatgaccccagatgggagatccttaggtttttgggcataaaagaatttttttaaaaaacggaactaaatacagcagaaaatgactataacaataacatacacgtgtgcatattttgaacatattttaggggagaactgttccatgtgataaacacaacaccgtcattttgagcccaactttcttcttgaaaaatatcaaagattttgcttaagttgccatggacaaacagacttatagacaattcagaatcatttggagagatgagggctacatactgtatttaactttcaaaacacagtaagtagattgagctcagcagtacacaaagagctgagagtttctgggataaacacatgggaatcagtgggagaggcagaaaaaggagactaaagattacaaaattcagtcacatttcaaaattttctgctacaataattcactttatgtagaattaatgtgtctgattgaacgtttgtgctgtaatttacttataattaacattttatggtgaacagatttctccacctccttcatgctgtgaactctaagccataggtcaaaaatagagatgaaacagataagcacaaaatattctcactgaaacattaatgagattttaatttactgctttaaaaacacatctttcatcaacgtctgtatataaaaatcacctttttattttaattttttaatcacattaaaaatataatgaactcttctagctggcagaaagacactaaaaaatctgatgcaggcaggcagtcctaggtagttaaatcattttccatcttgttcaggagccaaaaatattgtcttgtgaagaggtaatggtttagttcaactcagccaagaatctcttctcaattaatcagtgcattttgataggtaagaatttcttgcaaatggtgaccctaggaaaaccattcctactcccaaactaagacatttgtgaagaccaaaatgtgggtgggccttccatttgttggatttacttaccttaagggagaagcttgtgcctgtctaaagtttcaaggtagaacaataggatttcaaatgaagtgaggaattgggagcaagaaattttcatttggtactgaagttattacaaagtgctgccttccaaccaatgattaccatttctattaacgcaccagacattaagtcattaagtctcttattactccttaagacttgacctaaatctctctttctcaaagaggttacctttggtccactttgctgcaagcatcaatcatatccagtccttctccattgggttggactgaccatgagatatctgtctacttacctacctacaaacccacccacccacccatccatccacttaatgtgtgtctttcatgctaaattataaactctaagaggacagtcccacatctgagttacttatcgctgtaactggccatttgtaataggtacaataaatgtgtgttgactgattgaattactgggttgtcggttggccctctgggcatgaaatccagtgtgatttgttgtttccaaaaaagttgtaactagttgattccccattgagaggtagagtctactgttccatccccctgaatctgaactgacctgtgactgctttgtgtaattggatgtggaagaggtgactgtgccagtttgggccctgcttttaagaggaccagcaggttcctcttccctcaacatggaacatttgctctggagaatgttaactgccttgtgagaagtctcactaccctgagacttccatgccggaaggacactcaagctggtcacctaaagagacggtgtcagaaaacagagtgtaacactagccaccttcagctgttttaaccatcctggcccaggagccagacatgcaaatgaaggaaccgtctcaaacatttcagacagtccagccccgtggattccatatggaaaagcaagtgtattagtctgttttcatgctgctgataaagacatagctgagactgtgcaatttataaagaaaaagaggtttcatggactcacagttccacatggctggggaggcttcacaatcatggtggaaggtgaaaagcatgtcttacatggcggcagataagagaatttgtgcagggaaacacgtctttgtaaaaccatcaggtcttgtgagacttattcactatcaccagaacagcacagaaaagacccacccttatgattcgattacctcccaccaggtccctcccacaacatgtgggaattgtgggagctgtaattcaagatgagatttgggtggtgaaacagccaaaccgtatcagtgaggctctggagtgagttgcccatcttattgtcaccctgaggcatcccagctcagccttagacatcagggagccgaggtagggcattcccactgcatcctacccaaattcttgattctttattatgctcagaatccatgagcataataaaatcacagctgttttacaccattgtgttttgggatggtgtgcatggcaacaatagataagagaaacattctaagagtctacagtatgcaccatgtctttgtctcaatcttgggtacccatgacattttattctagagagaaaatccagacagaaccatgttccacccggatctcttttacagatgatacaaagatggtaggttctttgaagtagactcgacagacttagtggaaattttgaacctgatgccgatcccaaaggaataaatatctcaagaggagttcattcgtgttctttgaattccctaagacagtaatgggaccattcaagctaccaaattcagcaattttctcagaaatttgacttaggttagttagcaaaaatgaggctctgtttcctcactctcacagccaaatttctcaaaaaaaaaaaaaaagccatttacacagatctcaatttctttatttttctattcactccccagtccattctaagtcttcacaattactgcttccttttcccagttagggtatcacccccctctcccccacccacccaataaagagtgtgtgtggctcagggagaggagcgagactacaaacacaaaagcaaagatatatctgctttgcataagttacatcctgtcctttcaatcacaaatcttctataatgttatgcaaatattcaagacttttccatcatttatgataacagtgttgggaaagctaggatattcaagtataagacagttaaaaaaaaaaaaaactacaatagaaaactaacctgggctttgatttatcttctccaagttcagaccaaatgagaatgaagaccttttatgccaagaacatgctacttatttttcacacgatttacaaatggaagcttgtcattacaaatcccgatgtgactcttttttgaaccatcatgacgttgtcaggtgtccatcacagatggagtagctcataaaattagaatgaccccttgatagaaaacaagacctacacagacctggttttcataccagccacacctgcttttggaacaaaggtgaatgcatttagttcataaaaatagcacctcttatctgagaggtccaaatgcttcccaggaactttacatttgcattctcagagtttggaaaaagtggaaaattgattgcgagaatagagatcattcatccagttccttagtgcatcataggaacatgcaaactaaagagtgaaaataaagacccagggggctaaacaaaatggaacatacatgatggttctacattcttcccaccccagaggtccctttgttgcctgtctcaactcaagaacattccatgaaaagaaaggtgatgctgaagagagacccaggatgtgtatgtggaagccagcaaaagctcataattcaatgaagtcatttcattccctttactttctaacaagctccaacccattcaaaggacttattagaatttcaaatgaaaagctgaatactatgagcattgtaaatcagctacaaacagcttttaaaactgtgtcaggagaaatacacttgtaattttcttcctttttttaaaatattgcttttttttttttttaacttcaaagctttgtttgttaagaagcagttaccaatttatttctacagaaggaatctgattttggttggagtgagggggcccaattggagcaatcctttcacctgggttggtacgcgctcccagcattataccgatttgtggcacatgcactactatccaggtgctgggtgtcccttgacaaaccacattgcgttatttattttattgttgttcttcttcagatttcttagaacccgaagcagaaatatcccttacctgggaagaactgtgattcagactcctccagtcctggagaccatatgtggtctttaaaaatgtccaaacaagaataggatgccaggggagccgtccgtctaacggggccagcgggcagcagagtcctcctcaggagtcaggagcctttctcctcttgcaaggatgtcccgcaatctctcatatgttcatctccctgagaacttgacagggtcgtgagacagggatattttatacttgttccttgttctccaagtccctggaaagaaaagaaatagatttctcaatttgtaaaaatcttaaactgagattaattttcaaatagaagagatacattcctccccactttccccctcccttccttcctcctttatcttcttctgcagcacagaaggcccatgtgattacctagatcaccttccacactacccaaagcaaaaagacgaagtatcacagcagctatatccacaggaaaacatccacagcaattgggcgtccttggtgaatgttactttctttacacagaacgcttaccactaacgacttgcaaaacataggacactatgttctgataggcaagaccacagccagctttgacagaaagaaggtgctactcagaatcacaagcttctttctctcttctgtttcagttctgaagagtagctgctccaatgtcaaaatgaaaattacaacctccaaattaatagagtgccgctccaaggcctggagagtgggatccagatgcaccttctatcgggatggaaaagatttaatcaagctgcactgactatttattgaacacagaattactaagcatcaactactgaaaaccatatgcatgacctttaaaaactgataattctctgctggcctcccctttaaatcttgcaattatattccgagcaaaatacttgaacagccaagtcagaggagtgccccaaaactccgcttcagcgaggcgtaatagaagggtctggggctgttgaaagggacagattggagataacattcaggtggaaggaaatctactgattactttggttagaaatggaggtaaaaccaccacatatagagggtagcggagccttgtgcttctgagcaaactggtagaaccactctcttccctttcctgcaccacctcccccaaccagcataaccctcttcctattttggagaatttttatagaggaaagtgacagttttcttccaagaggtggcatctctctggaaaccatcctggtggacaaagcgataatgatgagaggcccccatgaaagagaaaatgctggcatcaggaatggagaccatgaggtctggtctttcagggacagtttcccccatcggtggcagccccagagcgcctggctttgactgcatcacgtgagctggaaagtttccttctatgcaaatctgcattattagtagaagggccttgaataagctgctgaacctctctgaaccacattcagacacttacaaaacgagggagtcggccgggcacgctggctcactcctgtaatcccagcactctgggaggccgacgtgggtggatcacttgaggccaggagttcaagaccagcctgaccaacatggtgaaactctgtctctactaaaaatacaaaaattaacctggcgtagtggcgcatgcctgtattcccagctctcctgggaaggctgaggcatgagaatcgcttgagcctgggaggcggaggttgcagcgagccgagattgcaccactgcactccggcctgggcaacagagcgagactccgtctcaaaaaataaaataaaataaaataaaaatgagagagtcatacctacttcatggtgatgactcagtgaaggaatgcatgggaagttctcagcacacagcctagctctgaaaagcttgattggagttcctttccatcccaacttccttcccaggaagatggagacactagctagctaaataaggggcacttaagctcaggtgtttaacagattctccagcactttataggtgctggcttcacaggaaggcacttgaaccattttgtcctgcaccatcccgcaatagacacctgttcttgaaatgacttggttttcatttctctgtttcctggttagtcaacagaaacatctatctttatagaaattactttcaaaccccttctctctcttattatgcctctttctctttttctttcttccttttctatacacattttcagccccagagtggttacctgccaagacacccaagtagaattcttttttcttttctcctttctttctttctctctttctctctctctctttccttctttccctcccttcctccctcacttcctccctcccttcctccctcccttcctcctttcctccctccttcctccctcccttccttccctccctccctgagtcttactcaattgcccaggctggagggcagtggtgcaatcttggctcactgcaacctccgcctcccgggttcaagcaaatctcatgcctcagcctcctgagtagctgggattgcaggaacctgccaccacaccctgctaatttttgtatttcaccatattggccaggctggtctcgaactcctgacctcaggtgatccactcacctcggcttacacctgacttttgaactgctctttagacccctgctttttgtcttgatgcgggttggctccctcggtcacctctccctaccccaggtcacccccaacctttatcgcattttcttatgcttttgtatgatagttttcctttttagtaaaaacatttaaaatgatttccgattgtctgctctgtaaactcttttccctgttttaaataattaaggaatcaatatcattttaacatatctgtaagtcttcatattagtaacaactgaaacctccgtacgatgacatggagaataaacatccctgtctatagcattctaaacgacttacccaagaagctcatttgcctaattactggagttaatgaaactcttccatctgcttttaacgtctcactttctatcacacctatctgccctgtttatgggtatcagtaagatgggcaatagcaaagagtagacacgtatgtgagacatactgaataattcctccaaacagaccagagaaaacacaaaaagttaattttaaatggaaaagctcatggagtccctggatgtggtgagttccttcttataaaaactaacctttttattttgagataattgttgattcacacgcagttgaagacacaatacagaggtaaatgtatatgtatcatttgccatttcctctgtattagtccattttcatactgcgataaagaactgcctgagactaggtaatttataaaggaaagaggttgtctttttgttgttgtttttttttctgagatggatggagtctcattatgtcgcccaggctgaagtgcagtagcactatcttggctgactgcaacctccacctcctgggttcaagcaattctcctgcctcagcctcccaagtagctgggattacaggcacatgccaacacaccagctcatttttgtaaattttttttaagtagagatggggtttcaccatgttggccaggctggtctcgaactcctggcctcaagtgatctgcccgccttggccctgcaaagtgctgggattacaggtgtgagccaccacgcccagccaggaaagaggtttcattggctcacagttcagcatggttgggtaggcctgagaaaacttacaatcatggcaggagataaaggggaagcaaggcgccttcctcacaaggtggcaggaaggagaagtgctgagctaaggggaaagagccccttacaaaaccatcagagctcctgagaactcactgactatcacaagaacagcatgggggaaaccacccccgtgattcaattacttccacctggtctctcccttgacacatggtgattatggggattacaattcaagatgagatttgggtggggacacaaggcctaaccatatcacctccaatgataatatttccaaaaccacagtacaatatgacaatcaggatagtgaccttgatactgtcaagatacagaatggttccatcaccacaaggagctctcctttgggccacacccccttccctcccattcccactctctccttaacccttggcaactactcctctgttctccatatctataattttgtcaattcaagaatgttatataaatggaatattacagtctgtaaacttttgagattggctttttttcactcagcgtaattctcacatgattcatctaagtggtcgcctgtatcaattgtttgctcttttttattgctgagtagtatttcatgttatagatattctacagtttgcttaaccatctacctactggaggacaactggattgtttctagtttggggctattacaaatcaagttgttataaatagtcatgtacagtattttgtgtgaacacaaatttccataaatgatctttgtggtataaatatccaggagtgcagttgtagggtggtgtaattgcttgttgttgttgttgtttttatgaaactcccaaattgttttctaaagtagctgtgtcattgtacattctcactagcaatgtataagtcacttgatttttctgcatctgatatagtttggatatgtgtccttgaccaaatctcatgttgaaatgtaattcccaatgttggaggtggggcctgggtgcagctaattggatcatgagggcagtttctcatgaatgctttagcaccatccactttgtgctgtcctcacaacagtgagttctcgtgagatctggccatttaaaagtgagtggcacctccctgccactttcttgctcctcctctggctacgtgatacacctactctcccttcgccttccaacgtgattgtaagtttcctgaggcctctccagaagcccagcagatgccagcatcatgcttcctgtacaggctgcagaactgtgagccaattgcctctcttctctttataaattacctagtctcaggtatttctttacagcaatgcaagaacaaactaatacagcaaccttgccagaatttggcattgtcactgtttttaaattatttattataataggtttgtcatgatatctcatcatccttttaatttatgtttcccaaatagctaatgatgttgaacatttttccatgtgctcatttgccatttgtgtaccatcgttgctgaaatgtctcttcatgacatttgcccattttctaattggattgtttatgttcttactgttgagttttaagtgttctttatatagtctaaatactagtcctttgttggatatggggtttcaggtatcttctcccagtctatagcttatctttttgttttcctcttaaggcctttcatagagtaaaagtttttaaattttttggagtctaagttatcagttttgcttttatgtgtcaagtccaacaaatcttttgtagtcctagatcctgaagattttctcttcttttttctaaaagttgtatagttttatgttttgcattgaattctgcaatccactttggattcattttcatgtatggtgtaaaccaagattgaggttcacttttgtttacctatggaagtccacgtatacaagcagcagtcactgaaaggctagctttcctccactgaactgcttttatacctttgtcaaaaatcatttgtaagtatttgtgtgggtctatttctgggttttctattcttcttcattatccgtgtaacaataccacacagcattgattcctatagctatttaattagtctttaaactggctagatgattcctctcactttatttttctttttcaaagctgttttagctattcttgttcctctgtccttccataagtatttttgaataattttcctatattacaaaaacttgctggaattcggataggaattagactaagcctatatatcagttttgaggaaaattgacatctttcctatgctgagtcttccatcaacattgaatgtctctccatttattcaggtcttccttgatttatttcatcagcactttgcagttttcaatatacaagtcctgtacatgttttgatagatttacacctgcgtatttttttttagctatggtacatgatgtatttttaatttggtttccatgtgctcattgttagtatacagaagtgcaattgcttttgtgtaagtttatcttatgccctgtgactttgttgaagtaacttattcattctaaaagctttgtcattattgttttttgtagattccttgggattaaaaacatttttattctaatcctaaatttccttatcccttgagattttcaatgttgacaattatgtattttgcaaataaaaatacttctttttcttcctttcttatctgtgtacctttgatttctttttatgaccttaacacattgactagaacttccagtactatttggaatgagagtgttaagagtggacatccttgccttgttcctggttatagcggaaaagtgttcagtcttttatcattaagtataacactagctgtaggtttttgtagatgctctttataaagttgatgaagttactatttctttatttctaagagtttttatcatgaataggtattcaattttgtcaaatacttttctgcatcaattgatataatcatgtgattatacattcctcttctttagcctgttaatatggtggattatattgattgatttttcaatatctaaccagtcttacatccctataataaatgccactgagtcacggtgtatcattctcattatataatgttgaattctatttgcgaacactttgttaaagatttttgcctctatgttcatggggcatactggtctgtagttttcttttgtactattttagtctgggtttggcatcaatatagtgttaacaacataaaatgaattggaaagtgcttcttttctggatgatattgaaattgtgtagaattggtgttaatgcttctttatatgtttgtcagaattcttcagtgacttttctgatactccaactccccttccagatcttactgccccaactcctcccacaattatgcaaggtctgaagtctataataaatttcttagtccataatactcatagtttctgcttccctgattgaaccctgataccttaaaatcatttgctattacagtggaataatagttaacatttactaagtacttaaaacatgccaagcactttacaattgttatttcatgtaagtaatcccattaagaaagtgatattgtcccctcaactttacagaaaagaaaactgaagtacagagaagttaagtaagctgtgaacagtcacacagtagggatcagaagcaggacagaaatcaaactcttagccaggctgtctactaacgttctttctcttgacctctaatttctctcagaagaccagagcctatggtgctgatacgatagaaggcatagatttgagcctggatcccattcatcgtttctggtataacctgtgcttttcattttgtttgctttccctttataccctcctgccgtttcccttcttttcgttatctcttcttttctctgctcattgaggatgtttcctctggactttttccccgtcgaacccctccccccaccttcctatcaccttttatactattggaaagtgaatcagacccacaggtgtgtgttcttccagattcgctggccctcatatcatgaagcaccagcgtaagaacaagggcaagccctggctagggaggtggctggacggatatgcagtgcactaaacagaaggggcgttcgttacagcaagagcaagggcagcagacacacacctgctggaaaccagaagaaaatggtccgcagtgactctgagaaattacctttcttgttctgactcctttttttgctcactttggggtcagtgaacttatttattaaaacgtctaccatgccttaagaaacagcattaatgcattaaaataaacaatactgtggatgcagaaatgaacatttaagtggatgcaaaccagatccattccattttgagtgtgtgtgtatttctgtattttttttctcctaagtgcctttgcttagtaaaagccatcaaatattactgggaattattactaatttgtaaacagtcctgaagaattaaagggagagagaaagggaatgagtaagtggaagaaagagagaaagagagagagagagggagagagaggttaagctcaaaggcagagagagcgaaatggaccagattatacaaaattaaaaagcaaatacgaggagacaatttgtgccgagtgattgcaagcaattacagtccggctcttctggagggaagatgggggagggggttatttcagcttaaaaggagactttattcattcctgatcagcttctccaaccattctctcttttattcttggatatcaatttaagaaaaaaaaaaaaaagtcagctttcagatgttacatgttcacccctgtgaatccagccctgggcagacagtgagaatttaagcttccaatcggttctttctatagccctgaaaaccaatttgttcataaagaataaaataaggggcgggggggagaggggaaaacacaacacgagcatgtgtttcttttagaggagagcttcaattttactataattgtctaaagacggagctgctttgatctgaagaattattattgtgcctcaaatgccggctgccaatgtcacagctgtgctggggctcggtcacgccaaggggcttggggtccaacttagtcccagacccgcctttgggtccttctctctttatcgttcctttgtcaaatgggaaagttcattttcctagtatgtccattgaccatcgaaggctatggcatggttgatgttgtacaggtcccttggaaggcctggacacatggtggtgacatcacaggggcccaccaaggctgggcgggaggggagagcctcgccttcacatgggcaggcaggctggatgtgcacatgccctaagcaggctggcacgatcattagatgagaggacccggcacaccggccagctgctcttgctcatctgtgtctcctcaactcatgctcgaggtcagaaatggtctcggtacttgagagagacacagcggacccttcagcacacttccctgatttcaaggcttggagttcatagttattatccctcactccagcccgtgctgcgccaaagcagaggacagctcaaaacacagaattaaacatgtttctttcagacgcagaatggctaaaatctagatggagggtctgagggctaagccaagtcttcagggcgtgtattttccttctcatggctgaggaatagaccaggggaatctcttctgtatcacttccttggtgggccaggcaggagggacctgtccaccctcatctcacatcccgccacctcgaaagctgcctcgcccgtctcctcctggtgcctctgaggtctcactggagactggaacgtcctccttacctgctccttctccggttccccatcacctacagcatcgtccacactctctagctcagcattcaaggctctgcaggtaagctgccctgcccagtcctgctgccctgcctagtcctgcaccccaggtgaggagcccctctgctgtttcagaacacatcatcgaatgctcagctctgggtctttgcttacgtcttccccctacctggaatacaactgcttccttttctccttgtcccttgagttcttctctcctttcttggctccgcttctaactcaaaatacagatcaggtggataagaaaatgaattactctgaatggactgtgagactaagttccaggggcagagctatctaaacagcccaggttatagtctaggaggccgtgacagtaaggagatgacaggctgcgagggacaacccccactcccaccccaccccctcacctctaagccacggtttctcaaactggaagaatgcacagagctcttcacaaagaaaatgtggtaaaacacaagaatgtcggtgaacccttggggtctgaagattccagtatgaaaaacattgtcataggaaacaaacaaaaacccagcagcatgaaaacatgaacttaattatagctctacaaagcaggaggcccacattctgcacagaaatcattcttttcaatcgcatgaaaaaaaaaaatgcacctaggccaggcacggtggctcatgcctgtaatcccagcactttgggaggccaaggcagttggatccattgagcccaggagttcggtaccagcctgggcaacatgggaaaaccctgtctctacaaaaaagtaggaaaattatctgggcatggtagtacacacctgtggtcccagccactttggagactgaggtgggaggatcacttgatctcaggagatggggttgcagtaagctgtgattgcaccactgcgctccagcttgggtaacagagtgagaccctgtttcaaaaccaccatcaccatcaccaccaaaaccccacatctagaagacttttattacctaggcaagcttgatttagttacttaatttctctatgcctcagttttcttatccggaaaagggaaaaaaaatagctgatctggaagggtgggtgcggggataaaatgatggagcatgcatgtgtgcacagtacttagatgactcctggcacattctctgttctcaacccatggcagtgttcatcaaactaaccccagtaggcacctatgttgttactagaaagctcagggacctaatcctgagtagatatctcatttcctcttcagagctaggagatctcatattctgaaatttttagaatgtgggaaggaggatgttcaggagactggggctttgatgagggctgagttgcaaccacagggaacactaagaaagatgacacagagcaaagcatgagctttgagcaaagaggaggcgaactgatttttttagggtaacaaaggttgagcgtgacagacctgacatgtctggccagctgccctaaggatgggacaaagggaggaaggctatgctgcagagctttgtagaggaagagctacttgaggagaaggaatggagttgttataaagattctggctaaagggaactgagtgatctttgcatctcaagaagtcataaaaatgggatgaatcaggagtcaggaaaagagagggagacctatggagctcacggaaacgtagagaacagccttggagcatcttgaagaggagagagaatggaagcaagatagctccaaaagaatgtctctgtcttactttggttgccacttccattaactgcccaataacttcaggtgttggaatagacaagagaagccctacctatgtggactctaggtcacaattcttggctccacagctcctgctctccttacttgcagggaaatgggggttgaacagaaacaaagaagaaagtgtagaaatgaacaagatgtaggtagcagggaagtattcagggggtagtgcaccgacaggcacaatttaccttgaaatacaataaaaataaaagctggattgacaggcagagggacaaacagatgggcagattgtgataaatcaagtatattccattgttaacaattgaacgtaggtggtgagtgtatgggtattcactgaaaagttttattttgttttgttttaacttctctatatgtatgaaaatgttcataatagaaaattgaaaaaaagttaggaaacagattcaagatcatcaaccctcgtcctcattggccctgagacaaattatcccaaaagagcagctggcagaatggtgaaggaatagatttttgtctgctcttcctgctgacttccagctcctcagtgctgtctgtctacctttctggggctgggtaacctgctaagaacaatgcttgtaaggatttaagctatgaacccagcctgtggaatctgtaatttatcagagctctcctaaaggctgatgcaagtctttaatgcccaatgaaatagatcttcagaagtggaattttggccagtggagaagaaactttaggtggtgcatcagttgggattagatttggttacaaatgtcagacagtcccaaacaactgacttaaacaagatggaagctcatttcatgctcacatcaaccaagtccaaatggaagtggcccaaaatgctgtcctcaaacatctcaagaactctggtcctttcctgctcatcgcccacacctctaaggacagtcctcagcctcctggcccaggatgactgtccccatcttccaggcagcaggatgatggaaggaagaaagaagggggcaacagcatgcacaagccaccccttaaggacggttcctggaaactgacatacgggcttagtcacatcttcacacccagctgcaagggaggctggaatatgtagtccttattctttgcaataatgtgcctagcaggaaaaaaattagctaggcgtggtggctcacacctgtagtcccagcactttgggaggcccagacaggtggatcacttgaggtcaagagtttgagaccagcctggccaacatggcgaaaccccatccctcctaaaaatacaaaatattagccaggtgtggtgggacatgcctgtaatcccagcttcttggaaggctgaagtatgagaatcatttgagccctggaggcagacattgcagtgagccgagattgcaccactgcacaaagaaaaaattatactactatgaaaaaagggagaaaagatttgggaggagaaaagatttgggaggagaaaagatttgagtttttctcaaaagtcaggagagtgtctccctagaatgctccaatcacaaatgcacagttttctacattatcttcatatagggtcagctctgactttatcaactggcctctaccacaatggtctcctttctggattgactgcataatgaggaggagaaggaaagaagaagctgtgtgataagtgctttagaatttaacaagcaaagttgtaaggtaggtagtagcatcctcatgatagagataagaactggaggcttccaacaattcaaaagactggtaaggtccttatctgtagaggccactgttaaaatgcaggaggatgcagagtggggctccccagtctttcccaccacccagcccctcgaccttgatagataatctgaaccttggaaaggacagaggctgctggagagccaagaaatcctagacaagggatctcacctggaggggagaacaagcaacaaaagctggaatagagcaagagaacactggtccaagagaacttcagggaagcagcaagcgaacatagagccaagaagggccagacaaggttccttgaagagctgggggctcttggaggatgatgaacaggggtgcggtggggagaggggaacattgtcaaagggaggtgtgcagggcagaacagagcacctgtatatgtactgccatcttggatctactctaaggattagaatatgagttctgcaggttctcaaagaattctatgttaacctggtgtcactgtcttcttgagcagaagttctcaaagctgatgcccattgaaatcacctgggtcttttaaaaacatcctggtacctagtcccaacctccaatatatatatatattttttttgagacagaatctcactctgtcacccaggctggagtgcagtggcgtgatctcgactcactgcaacctctgctgcccaggttcaagtgattctcctgcctcagtctcccaagtagctgggattacaggctcctgacaccactcccagctaatttttgtatttttagtagagatggggtttcaccatcttggtcagcctggtctcgaactcctgacctcgtgatgcacccgcctcagcctcccaaagtgctgggattacaggcataagccactgtgcccagcctcaagatttttattttattggtctggggtgaagcttgggcattgggatttttcagaactcccaacatgattctaatgtgcggaaaagctggagaatcactgctccagaatgatagtcttccaactctaatgtgtatattcatcaccttgggagggcaccgaaatgcagattcttattcatgaggtccaggatggggcctaagactctgcattttaataacttcccaggggatgacaataccgcccatcttgggaacacactctgagtagcgagtttgacgctttcatttctcctgctaatgtacacttttcctatattcacgggggcttcaacgcatcatctacttatgcaaagctgtctcgtcctgtaataagcaagcccgtcccggacagaaacccaggccatgtcctataataagtaagaccatcccagacagaaatccagacagtcctggtctgtatctgccttcacgtttagcgtgttgtctgctaaaccgttgatctagagtgtcccatgttgagcacagcagaaagcacaccactagtgcttaacacagcttttattaatattaataattaatgcttagtgctaatgagtaaccaattaccaatagtaataatgtcatcgagaaaacagtgatagtcctacaaggcacaaacctttctgcttcgtcccccacaccccaaattatagttctaaatgagcttccagaatcttgtgacaggtacaacctcacacgcattcatgtaataagacagctctatggagtgaaattccactttcaacagatacattttcagcgtggcacacaggaaattaaatgtgaaagtatcattaacatggaagttgtgagtttaattccctacacagggtgctgaaaaactgagattgtttatctatacctcatcacggctacctgtttcctgggggatccagtcaatttcttagaatataaactctcttaccccttttttgggtgaacatctactcttcatttctatcctcaaagatccatattctcagaaggcaaagaagtgaatgtgagcatctcactaagaagaacaggattctacagtgtggtttgagattgctaaggatggcattcagggctgattcaggacatgatttttttttctttaaatatttctctttagaggaagtaatgtagcacttaatgtctaatgacatctattcaggaattcatcaaagaaaagctgataacaagatgcgttatcatagtcaacaattaatggtgccgtgtaggaatcttgattgctcttaggatgtgtaactggtacagcttttgctcttgggctgtttttacaaaaaggcaagtggagcacagatgtacctttccgaggtgatcgaccatagtgattgaccatgcaccactgcaagtcatagctaaagagattagccaaggtaggctattcatgccctacattggttacatgtgggcatgtaaccaatctagtttgtgaatctctttctttttctttctttttttttttagacagaatttcactcttgtcgcccaggctgaagtgcaatggtgcaatcttggctcactgcaacctccacctcccaggttcaagtgattctcctgcctcagcctcccaagtagttgggattacaggcgtgagccactgcacctggccatgaatctctttctttctaaacatcattcatcttcagttttacccttcactgcacatccaactgacttgggtgagaggagtaaaaggagggctcaggggaccctttaggggtcaggataccctcaaggactaggtcaaaaggaattacaggaaaagaattttattgacaatctcacttgagaagaactcacataaaggagactcaagtatctcttttcctcttgctggaaaaggagaaaatgaggaagctgcttgaatctttagggttagtcttagcctggaaaaaaccctgcagcattctgagacatctgagaggagctagcatttcaaacaggagcaagcccgctgcatggtggtgatcctcctccccactttctgatcctgacaaggtgatgctcaattgatccagtgccctgagcacctcagaacctcctcttcctccccacggactcatttctgaggctggttcacttcacctggagaagcctatcattcctcctaatagtcttttggttttgatttaaagatctactgaatgttagaaccaaaagggtcttaaaccaacttctacccccaagttccttattttacagatgagaaaacacccagggagaattatcaaaagccccacagccgcctggaacatgagcccatgttttcagactctcaggtcaggattctactttttaaatcttaaaaaaaaaaaaaaaaaaacagcatatctaaagtcccaaagacatagctcttggattctcttgcccatggtggcacgatgtgaagtcacacttagctggcttggtaaaactaagaaactcagtactggcaggctgttgcccatgctggattttgatgaagccacaaagcttcaagttcactgccaaaaagctccaccacattggaagagagaattttctacttcaccagtgggaagtgggagaaatagcctcttgagttttggatggatcatgagtgcctgagtcaggagggtattattctatttaccactccagactcacccttcattttccctccttctccgtcctaccgtctgtgccatgagactggcctctccagactgcatcacctagatttgcttgtcttcagctgggtttggccaatgggaaggcccagaaggaggtcagcgatcaggggattggttagtccagctccttcctgcctcaccatggtttgggcagtagctgtgtccctttccctgtggtcacagctcctggcacaccacctctctccctcagctgcaggtctcgcccagcccagaagcatggttccttctattgccaccttggtccactgagggatttcatcatctcttgtcaattcccattaccctttcacctccataaattgtcccattattaaactctctttgttaaactaacacattgagtgtgctgtcttttttttttttttgccaggaccctgactagtacaggggcccctggatgaagatgtatcaggtataagatgggctgggcacagtggctcatgcctctattcccaccactttgggaggctgaggtaggaggatcacttgggcttaggatctcaagaccagcctgggcaacatagcaagaccctatctctacaaaaaatacaaaaattaggcgtgatggtgtgtgtctgtggttccagctactcaggatgctgaggtgggagggtcacttgagcccaggaggctgaggctgcagtgagctatgattgtgtcatggcactccagccctggagacagagcgagactgtctcaaagcaaaaaaaaaaaaaaaaaacaaaaaaaaaaaaaacaaaataataagctatgtgagctgacttgtgtatggaatcattccatttgaatgggaggggaggcgaaaataaggtaggagacatatgagaaaaccaacagcagttggcaaaatctgcccaacgcttgagagtcctggcctatgtttgatcgactcattcgaattatatgagaccagagtagaatcacagggctccacttcggtgccacccactgacttattccgtggaattgggtgggttcctgcttccacctctctgaagcagctgtatgattctgttcccttgcacacctgctgaaaagaacatgttgctacctgcaatatccaaactctaccatctcatggtaagctgtcttaaatgctaaaacaaacacaaattgaactggttttcccatctgtttctttaacaaatgggagcttaagcccatagggaaactgtgtgggtcagggaagcatcaaatgaacacttctgaataaaaacaaatgtttctgaagatcgcaagatattttaaacagagcactccgttggccaggcctgctcccttctgatgcctgcacaagatcccgatgacagcattatttgcttgaattggatttgtttctgtgcccagaaacaacacacaaggaacctgagataggaaatggctactgggtcctaaaagtcttcccaggacactgtctgagaccagacaggaatgaaacaagagttggaaaccacaccaaaggaaattctttggggtctggattctcgctcttttttatttatttatttatttatttattgagacagagtctcgctctctctcactctgtcacccaggctggagtgcagtggcatgatctcagctcactgcaacctccacctcccaggctcaagtgattctcatgcctcagcctcccgagtagcagggatcacaggtgtgtgccaccacgcccagctaatttttgcatttctagtagagatggaggtttcaccatattggccaggccggtctcgaactcctgacctcaggtgatccacccaccttggcctcccaaagtgctgggattacaggcatgagccaccgcacccagcctcttcttttactattaaaaaatatcaaaagcagagagcatttgcttgcatttttatataaaactccaacaggtgaactagcattcccagaggaggaggaggaagcagtggtgggggtggcagtggaggcagcagcttgactcaagcggagaacctggcatcagccccctgagttttctttagtcccctcttacaagcagatgctcctctgggtcccctccaggtctccatcccagctggcagcttccttgccctgctctggaactagactatacacaccctgactttagtctcattccattttgcacatcaccagtgcctaagaaagtgcttggcacatagtaaatgctcaacaaatgcttcgtggttggttatgtcgattaacctatgaatgatggagccagcgggtaagagatgagtgggtaaaggaaagaatcaaccattgacagtactgtctctctagttgatacattatttctttccaaatggggctgggaggagtgggtgggtaattgccaccagagggaccctgtatgatgaggtcactgggccattttcagggattcactactgtctcttgggattcctcatcctgtctccctccctctgtcttcctgccttccctctgctctctgactcttcgatccatttcttaattctttttgctgagtagttcttcagtttttatttctgttatagggaggccactctcacatttttgagaataaaagatagcgctgggaataatcaaaattacgtaatttaaaatattagcgtattcaccaatacactgactttacgatattcgtggacttacaaaataattttatttaaaacctagtttcaaaaataaaattccttctaccaaataaatgtaacatatatctgtttccatgaaagcaaaatgaaaataatttatcttattgaatctcttatttgaatgctaaacaataccgttagcagaacaatactgtttagcatgtattttatttttttgtcatatctatttctaatattattatatcatggtatttgcctaaaggatgtatattttaaacattattttttaatctttttttcataaagttgcatatcatatactcttcctcaaagttgcactttaatgctttttgaagtattacatataaaaagtactaaagttgcattttgttgttaataaatttgaaactgttaacttcctcaattgaatgttactgaagattataataacatttctaattgagaaaatactttctccaaagttactgagatgtcttataaattcagagcaaactctgctagagtatattccaattttctattttttcagattaaaatatataaatactttagcccaaatattttctcatatactgtctttttacctcccaagcactttggcaggtatttttaaagggaaaaactctttagataagttgtctcaacttatgattccaaatcataggtctttccatttcattccattgaataaaaatataaatgtatccaaataaaaacagaaatatcaaaagattcttcccagaggttaaggtattccaaaaagaaatcgtaattttgaacaggaaatcttgcataatttttgaactctcaacttttaatttgttcggttcttttctttctgttatagggataacgttcattgttttcctgtttgcaagcttcattttcaacagttgcaactagctaaatattttaacataaagtttttttgagcactctattcttttgagattttgattaaatatatccaactggtgttgaataaaagctaaatattttaacgtaaagtttttttgagcactctattctttcgagattttgattaaatatatccaactggtgttgaataaaatataaccacaatttacagatttatttataaaagaagttcaaaaccactgcagaacgtgtaggttgatttacaaagaaactcttcaaaggtgcaaactcttgaaaaactccattgatggcaagcagcaaaaagataaaaagtccacactgccacactaaagtattttttaatattcaacatcaacttcatcacaagaatattgtggcttgattgctctaatggagtatacacaaatatttgtaaatttaaaccactacaatttttaattgatttaacattgcagcaagtgggaggaagctgtgaattatatgaacaccaaaacaaattccaaacctatttctgtctcataagtttcttaattttatattgacattgctttttaccatgaatttgtgcttcaccaaagtttgggtgggtgttatcaccacaaaatttagtaacttcattttcaatgttaaactaacaagttcattaaaaaatggagtattactagtattaacaataagtcagatgtttcaccttctttagaatgaactttcagaaattttaataatttgatttcctgaagtggaagtgaaaatttgaaccaattattaaaacttatgcattttctttgtgaagtctccaatagcactgataaaacagatagcctttaaactgtttgcaatttttcttctgtctcaaatgccaatacattaagtgtaggcactacatgttttgcacctgcataacaaaaacttggaagaaaaaaattttagaaatttagcaaagaaacagtcatttgataacaatgaaaaatcatgctttgtagaagaatctgtaagcccacctgctacagattcacatgtgaattcatctataggaaagtcttcttaaaataactaccgatttttaaaattaaatgctgatattctgttagcaaatcttgttttctgtgtggtcatctgccacaataaatggtaaatattgataaacatttttgtgcaagttacatgtacattggctttcgtgagtaaggaaattcagtacctaatttttcattaaacatgtacatgtggtttttggagctgatggctgccaaaagggattacttcaaaataaaaatgttaccaaataataaaatcaatagttgcaaatgtcaattatataataaatgcaaaactggtattgtaagagcattcagactattctatgttctatggtggggctgctcagcctctgtgtcctgcatggaccaatattttcctgcacacctaccctctggtttccacagttcccgcggaccctgccaacaggcatcatggtggcaggctgcacaccacgggccccagcactctgcactggtagccggtagggcagcagcagtcacttctcacctggagaacctggctgatctcacgtgcttatatctgggtacacttcacatcccttgagaatggggtgtcagttaccttgtgtctggaacagagtaacaaaagggcttgggtatcactggtcgtctttcaaacctgaccacaagttcaaaggagaactctgaactagcatctcacacacagctatataagatcttggcaggagctggtggaacaaaaagcagctctctctacctacccctcctggcttattttgttgttgtttttgttgtcttcttttttaaaaattgagtcagaggctgggcgcagtgactcatgcctgtaatcccagcactttgggaggccgaggcgggcggatcacgaggtcaagagatcgagaacatcctggccaacatggtgaaaccccgtctctactaaaaatacaaaacctagctgggcgtggtggtcctgcagtcccagctactcgggaggctgaggcaggagaatggcttgaatccaggaggcggaggtggcagtgagccgagattgcgccactgcactccagcctggtgacagagcgagactccatctcaaaaaaaaaaaaaaaaaaaaagtcagaattaggtactaaaagccatatgacatgcctgaacagggacttgaaccctggaccctcagattaaaagtctgatgctctaccaactgagctatccaggcttcttccctgctagtttattttaatgcagtaataaataacagcactttgttaaaaataataaaggtataatctgtgacacatccaaagtggacaagatgaagagataataggtatacaccaggattcccctgggcaaactgggacctcttggtaccctatatattaagagtctcgggttttgttttcacttaagcaaatgtccaaactttcttatccttttctcttcaaagtgttttcctatgtgcccatcccttaggacttctagctcttgtataaacagataattgaggtgcaaatatctgatagggtgtcgtacaggatgattgcaaatcccatctgattaaggtcacagaccactccccagataaaacccagactcaagctgggcgcggtggctccagcctgtaatcccagcactttgggaggcccaggcaggaggatcacaaggtcaggagttcgagaccagcctggccagcatggtgaaaccctgtctcaactaaaaatacaaaaaattagccaggcatggtggtgcgcgcctgtaatcccagctactcaggaggctgaggccggggaattgcttgaacccgggaggcagatgttgcagtgagccgagatcatgccactgcactccagcctgggcaagagagcaagactccatctcaaaaacaaaacaaaacaaaaccagactcacccctcccttgttgtaaaagactgtgctagagcctgcagagtggttctgccctatccaccctcccttccttaccaatgacatgagcttgaagatggaagccacctgttcaagagagatgttcagaaaaataagtgttgctaatgactggggagctgccatatttattcattaccaacctccagacccagcagctgattgcaattcttgacctaaacaattacacattgctgaagttcttgcttcccattccaggctcttctgcctccactctgtccttgcaccccaaacccctgccatacaagtcacgaaactcattccactcatccttcatccatgctattaccttggctggagatacctttctcagccttgacatccagctacttctgcccttctgccagaaacaaacgtagtcatcacctcctcctggaagcctctctgggctgcactcctgagacatcccaggcatgctcctgcactctgttatatgatcacctgttaacacgcctgcctccttcaacctgtgatcagcttgagggagggcactgtgtgttctttcttcctcagtctgtcatcctgtgtcaccatgcctcctatatggtgacatagcaggcatatgtaatgggaaatgattgaatgaatgttgaaactcaccaaataggggagggtcctggaaagcctctgggaggaggatacctgattggcctgtaaaggtaggggtcacaatgtggcagttacacattctccatcaataggatcaggtccattatcctattaaacctccttggggaccttgagggtgagaggacatgcctattagtaacccccgtttatggctgggcaaatggaggcatggggaggttaaaagctccgggtcaacccaggagttggtgatgaacctgctgtgattggcagtcgtggggacctgatgccggttttgttctctgaacctcactactttcaaggactcctcagttcattctctcaatctctttctttttgttttcttttttcctccagtaatatccaaaaagtcccttctccagattaaatcgtcctggcttcagatatctaaagcagctattttttttttttccttcagcatttgaaatgtttttaagggtttatttcaaacacccttttctttgaactgattgttcagaactttcattccactttgtcagtgtgtttggtagtaggctccgattcctaaaaggtttttatttcttctctattagcggccaccacctgcttactgtttggatgggttttgctttattttctttgctttcatctattgaaatggatgagaggaaccttaggtaatgaaccttgtttccagttttccccctcacctcccctatttttaactcctcctgccactgctaaggatgaggcaaaggacgaaaagttcctgggtggtaagtctctgggagtcactctgcttttctccccaggtgtggggatggagtggcaggcagcagagggcagaatgtgcctggaatgtttgcagtgctgttggctttgcaattgcctggccatcctgtttccccacagcaggatgcatggtggccttctaaacggccactctggctggagtgaagaggtgtctttctccaatcttacagggacccctaagcttcatggggagatgtgagtgtcagtagctgttgctgaggcccacattgccagacactagcttgttccatttttggtttatctacacacattggcccttatgggagcagcctcacatataaatatataaatattttaccagttcatcctgccctcagggtatcaagtttaatgaactaaatagcctccattaatcacccaacagaatgttatttacttcaagggaaagggtaagtggcctctgcaaagacacgtcaaggactcggtctcggcaactcttctctgtgctaggtcttcccaaatctttaagaacaaagtcctaaatcccgggctgggtgtggtggctcacacctgtaatcccagaactttgaggggctgaggcaggtagatcacttgaggtcaggtttgagaccagcccggccaacatggagaaaccctgactctattaaaaatacaaaaattagctaggcatggtggtacccacctgtaatcccagctacttggaaggctgagacaggagaatcacttgaatccaggaggtggaggctgcagtgagctgagatcgcatcactgcactccagcctgggcaacagagtgagactccatctcaaaaaaaaaaaaagaacaaagtcctaaatccagaagttctgccagccaagttgacacattgctttcctgtcctctcttctccccttaccaaattttagtattactttttaattaattaaataattaaagagggtctcactctattgctcaggtggagtgcagtgctatgatcacggcttactgcagcctcaaactcttggtctcaggtgatcccccctaccccaacctccagagtagctgggaccacaggtgcatgccagccatgcctggttaatgtgcgtggtgttgtttttttgttgttgtttgtttgtttgtttgtttttgtttgtttgtttgtttgtttttgtagagatagggtctcactatgttgcccgagctggtctcaaactcttggcctcaagtgatcctcccacctctgcctctcaaagtcctgggattacaggcatgagtcaatgtgcccagcttgcctaccacattttagatgtcagtttcttcacccttttgtttaaaatacggcatactctcccatatctgcccagcccagaaatgcacggtcatgggttatgtcagcccagggagggtgagaaaggtcttgagccctgttgtcatgatgaccccatagccaataaatcaagtccagtgtaagtaacatttgagcaactggagaaaatggaactgaagtgggtacatatcagaggccctttgacatctctgaatatcctttgtaaataatatctattgcccagcttagagctgtgagagccactcagcgcaagtgtatacgagtggaaaaatgaaggaaagggaagggcagagggaagggagtggagattggtgctgagacacagggggtggccttgggagctgatacagcagtgcctgtgttaagctaggctgtccatcctttggcaccccagtccctactcctgcagccacagatgaaaggcaaattttgcaagccaacatctaccttgccccttcctaggaacagtgaggtcctatccattctgatcccactgaaatctaagagaattggtggagatctgctatcccagcccagaaaatggcatcacgtgtgaggatcggcccttcacatcccttcttttgcagggctgaccaccgcctcacccactccctgctagaggggtccggcccctccctgcacacatccagactctccaaagcatcttgcatttggccagaggtctcgggaagcctctccaggctgtgtagggctttagcccaacactaattagtaatgcaatcccgcaaagagtgaagctgcctgccacctcccctcactcatagtgatttatgttcaatttgtacaaatggagaaaatgagatttcaaatttcaatgccatttctgcaatgaggtgattaaaagagagagaggtatcgccttccactgtatagaatattgatcccagtgctattttcctttgcaataaccattagctcagtattatttgcaaacctctaatgtgaacctggagatgtaatttacatttgtgcctcacttattcgctttaacaaaacaacacaaaagctttggatctttcaatctatccatattgtcaataaaattagcagcttgaagggaaaaaattatattcaaaaccataacttcccattaactaccgcaagacacaacacatcgttgcaaaagagagagagcttcgtagctaaatcctttcttgttctttcttttcctccgctccctcttccccctccatggggttagaattcaatgaacaaacttgaaagtgaaacatcccctcctctgaatgtggatcagcttagggtctgggggctggctgtgcacatctgaggcccgatccctccgagggtgaccccggaggaagagaacgcgtgggcccctgctccaagtgccagcgcacgcctggcccagaggtccatcgggctgccaggacaaatgcgtacgcatagacacgtgcacggagcctccgagagagagcgagagaccaagagcgagcgagtgagagacagagagagagagaaagagagagagagagagagttcctcaagagagccgggagccagggtagggaccaaaagggctggaagaaaagatgagaaggaggtaatcaagaaataaaagcatgggggctgtgctctgccaattcaaatggcagttccgtcagcctcgacgctgaacaaataggccacgtagctccgcgttctcatttcttgtctctgcaaatccgtcagctgcctacaagggcctaccagaccctggaagacgagaacaagaaaaagggagagtggggggcgggggagctaatgacccataattgccatgatagtgggagaggggccaagcagctgttttacattcctggtatgtatagtatgcaaatatcgacaaaggctcgacacagtttcgctattgtggatccggagggtaaccaaattagcctttggcagccatggtaattgggaggtgctgttcccattaggagtcctgcaaattatgaagaaaaatggaccgagggctttgtcacaaataataataccaagaagaaaagcgcaggcggctgtcttttcttttcttcccctgttccccaccctctgcctttgttttttttttttttttttttaatttctgcattgtgttgttaatacctctccatttagtaataagaaaacagtctgaaatcccccactagacagtgcacggacttgattgcaagaatgtcaagtttgcaggagggtccggggggaagagctgctttctgttgcccgagcccaggggctgcaggtaggaaaggcgcagttgtgcagcagtaaagacttcccgcccagagtcctaggtgaagagagaagcctaaaaactgacgtctcaaagaaaacgctctttccacgaagcatcttctccgtattgtaagggtgcagagaacatctcttcctggagcatagctgggctttatcctccacctcactcccaaagagtctaaagttctggcttgattgaggctctaatctcttaacaattcagacatgggcttgaaaaacctccagtcatgatgcattaagccccgaactcatgccgaaaaggtttgcagactttcgcccttggcattcccttgagatggcctaattccatgtccctgggagctgggtgcctggtgaccagatgggccaccggcatatcagatgacgctatgatgagctcagccctttgtggggcatgagtaaatgaggcagaatggtccgttcggggccaagtttgccccagaggagagacacagtatcaccacggtagcagggaactgtgatgcctacagtgcatacccatgtgaggagtaaaggaccaatacttcccaaagcattctctcctttaaaacaatcaacttccattttcctatgttttagcatctgttggtttggccagaggaacaccttcgatgagaaggggctctctggaaatacgatgtctttcatctatgttcctccagttacataggaacatctcatgcatggttcgcattttatttttacattgtatttcatacaaatgtacaatgttaaaacacagaaaggaatataaatctacttggataactgaaaggatactaccacatactcgcctttagaaccagacagaatttcccataaggaaaaaaaaaaatggaattttcataaggtttgaagtgtcctcagagacacgactataaaaggatactgccaattttgtcctccaaagggtaaagaaagaagtaatggctagttgcatgcatttgggaaattaacaaaaataggaggaggactgaaaatagatcaggtcatagcaaagtcaaatagagggttgaaaaatgagtaagaggaaacggcaacttgcttgcacaatgtcagtgcaggtgggaccaatgggtgacttcaggaatggagtgaggaggaaaatagccaaccatgatactggtttctttcctttgtgtaatgtccaaatcccatttcagtagacaagggaatactggcccccattccttgctagttttaaatgaagaacattcagctgtttagatacagtccaggtttcaagtctgtttcaaggtaaatttgagggtgagggagaaaaaaaaaaaaaaaaaaaaaaactttctagcatttacaataatttttcttaagaaaaaaatattctttgatgaaaatactctaccatttggggactgtgtttaggtttttgttctaggtccaccccttgacatgctgataagggctgcagtgtccagtaccctgctcgacctttctctcttcccttctcagagttccagccacactaagtgtctttctgtgtgtgttgaacccagtatgctttttctcatctcttattttcacacaagctactccctctgcccgctggatgtccctgtgtactgccctaccatgtgacacaggtctgcacacatcccttgggctggctcatcctcatcctcttcctcaggtcactgcttagatactacttcccccacacagccttccagccttgtctgactttcttagtctgggtgaaaactcctcctaccatctgctctcaagtgcctagtgccggaacttatgacagaattttctgtctaatcacttttccaaggctgtgagcaacaggagagcagggaccacctctcttgttcatcaatgtgtcccaagttcctagcccagtgtctggcacatagcagttgagccataaacatatgttgagtgaatgtcatctgattattcagaagcttaattgagggcctaaagtattgaggcagcagaatgggtctgaaggcggggaacataaggctgattcatgctgacttcctagaactaaatcaaatggattcgattcagctatgacaggaaatatcctctccatttacacagggcatacacggagtaaatgactttgtaactttacttcatcctcttcatttacataggacatacaccaagtaaccagtggaaacctctagagggtattgaaacaccagaaaattctgtaatggggctcttgagcccctgtgctcaggcctgctcccaccctgtggagtgtactttccttttcaataaatctttgctttgttgcttcattctttccttgctttgtttgtgtgtgtttgttcaattctttgtcaagatgtcaagaacctggacaccctccaccagtaacagtatcacttgataacaggtctctaacacttggcttttgcattgaggaattctgccttcgaggaatacctatcaattccagaatcccagagggtcccccacataaagatagacctgcatttattccaaacaccaaaattaactggatagtgctgggattagaggtgtgatgcagtttttattctagcccaggactttcctggtttcctgctaaatctagggtctctcttgctcatttttttttctcttcaggaatgaagtttgcttttatctgcaaatgttgctaagaaagaatccatcgttcaatgtaccgtggtccactctgcactttagggtctcaggctttacccagaacctggagcaagaccacttcaactcttgcaagaaattcacaggtaacactaaggcaaattctttccactgtaaggccaaggcaatttgggttactgggtatttatatcttaggtatatatgtgttatggcataaaacctgcttggaaaaataagacttataaatggacagcaataacagaactaaaacgatggaaaatggtatgagagattggagttgggtagaagaatagtgttccttatgctgaaatagcttgctatttagaaaaagtgagggtttttgacctggaggaaatggcaaaagactatcaatagggagagtgctagggcagaggattcccgagtggaggttcataaaaaattaagctcggatagggaccacataggtgagagacgttaataacaaatgaaagagtttagttaatggtgggcagcttgggtgtggcgctgtagggtgcagttactcaaatgtcttctgaacccatctcaggaggactcttactaaggtctgttatagcaagggtccaataaatcacacctctctgtatctatgtgattttttttttttttggcagagtctcgatctgttgcccaggctggagtgccagcatgattatggctccttgcagcctcagtctcctgagctcaagtgatcttcccacctcagccttctgagtagctgggaccacaggcacatgccaccatgcccagctaattttttatttttattattttgtagacacgggttctcactgtgttgcccaggctagtcttcaactcctgggctcaagtgatactcacctcagcctcccaaagtgatggaattacaggcgtgagccactgcgctcagctcatgtgatttcttagcctcctcccgcactaactctgggcttggctttgtgagttgttttggctgatgggactttagcaaatgtgatgcaagcagaagtttgaaaagtgctcattcatcggagtttgccttctctggctctttgctgggactccttctagcaccatatgcaaaaagctgagcctagcctgtttgaagatgagaacctacatggaaagagaggtccacctgtcattgctgactcacctgaggtcccagacatctaagcaagcccagccaacatgatgtgatacagaaacgcacccacccaactatgtctagcataaatgttctacctgcagagcagtgagcaactgtatcatttttgttccaagcttctaatttggggggtgatttattcacttggcaataaataactggtacaaggtcctcacaaaaggagcctagaagaatttgagagaacaaatttgctcctttgggagctaatgtaagagctgcaaacactgaagaaagctaaaggaatggtgccatcctttagggctggctgatcagaagtgttgcaataccagggcaggttgagggtagcagccatatgggtggcaaaggaaggagggacagcctactatagtgctgatgaaaagagcaacatggacctgcacggggtggggtaggggtaaaggaaggcgagagtgatggagagaatagcagagcccacatcagcagggacctcatggcccaatggcaggccatggcactgtcagcccatctggagaaaccacagggatatgaaaataggtggtggtattgacacggatggaaacaactggcagatctcaatggctgcctcctgggatcctgggcaaataaacactggggatgggggtgatgttttgattacactgggaaaagcttcaattatcaagtttccctcattccaggcacttgtctgacttaggaagccataggattcctggaaaataaaactgtaggacaagatgtacaaaatccagcaaaagtcgtctgtcatcccagacattacttttctattttcatgaccccattgctattgaagttgaggtccaatatatacccagttgttacgatgctaagacagactggagatgaagagcgtttgttctagaaagaaccaaatgccagcttaaccacccactatttagtgaccctgggcaatttatttaaccttagttttcttcatctgtaaaatggaactaataatagttcctatctcatatggctgttgtgaagattaaatgaaattatacaaagtgtttagcatggtatcagatacatagcaaactcttaaagttgctatgattattttcgatagctatttagaactccagattttctgagcaattcatttggattatcaagaaaaatttcatcatctgaatatcatcagtaccttccgtgatacctaaaatatattaattagggaaaatgccctcttgatcccagcatttgaatctgggagggagagaagataatcctatactttccttatgtttggcattctaatgtattcctgatgaaaatcttgatgcacattcaactgtattggatctttatttttatcccatctgactagcaagttctcattaagatatgatttaagaactgaacgttcattaaaaagatcatttcatgacaaagtgagatgagcaacgtagaaatgattccatagcttctctagatcattccatttagggcttttttccaactgaatccagcataattcatagaagcactaagatttgcctttcgaaggtctggaataattcagcaattaacatcatacactcttattacctgatgcattagatccaaattgcaacaaataccaatgctagcaatttgtttttcctataacttgcttactttaagcagcattatcttggaaatctttcttcttaaattcggttctaagaaaaaatattcacaaataatttatttcaaaataatctctccttactttttttaaagagtagaattatgtagaaaaaaatcagtaacatcactttataaaaagaaacaaaattctgactcagaatgcttaaaacaatttttctctgataggtttttttttctgactgaataaaacaaagctcatagtaattgtaacaacattagcactctttcaagagtggagattagtcactgaaatcttgtgttctacaatgtcaaaatttgtctgaactgcacttcaataaaatcacaaaatgataacagtgtctccattcatgctatataaatatgaaaaacatcaaatcaagtggaaaaacatgagatgtgccatttatataattgttacaaatttctgttgtacaaccaatttctacaaaattccattgcagctattcaaatacttgtggaagaatatcttaaaacctttacatttcacgtcttaaagttaacttaatggaaatactatcagtagacacactgacagttttatcaagaattccgctgcagctcagaatggaggaataacatcagctgcttcatctactgagacatccagttcaaggatcatcacactaactccagtatttccactaacatattcccaaagatgggaagctttccatagtgtttccaaggcaggtttgtgaacttttgcccaattcccattgaaaacgttttaatggcataaaaatattctctcattgttcatgctactaaaaattttattttggtttaaccaatgtggaaattagtttcaaggtggacctgatacgtctgaaataaaaattgaattgctatgttacgtaactccacctttcactgacgcaaccccatttaacaaatccctttgcgttaaaacaataaaataggtcagtgcagtggctcatgcttataatcccagcactttgggaggttgaggcaggcagatagctcgagcccaggagcttgagactagcctgggaaatatggaaaagctccatctctacaaaaaatacaaaaattagccaagcgtggtggcacgtgctatagtcccagctactcaggagggtgaggtggaaggatcacttgaacccaggaggtcgatgctacagtgagccctgatagtgccattgcattccagcctggacaacagaacaagaccctgtctctcaaaatataaataaaataaaacaccgcctctccaatgaaactaagaaactgcagaggtgagagctaactgatatttctttgaatgaatatataatacaatgtcagatttctcctgtgactaatatttatctcattactctgttgggtgcagtttttatatatggttgccatatttctataaagtggatatacctttgacaaaatgtcatcgaaatattcttggtcaccctgctttttacactaatgagatttctattagtcaggataaagttaagctctgctgtggtaacaaataaacccctaaatctcagtggcttgacatatcacatccacacaaaagctgacatgacttaggaagtcctccttcctcttgaagctgagttatctggagtatggccttggctgttattgtgtcgggggcagagagatggaaaaggacctggcttttacctgtttcagcccagaggtgatacatgtcactttctctctccctatccattgactggaattggtcacatggcttcaattcactgcaaaggtgctgcagaaatatcacagagcatgcagatagctggaaagcaccaactgtctgccacaggcattaaaataaacataatgaagctattttgaatacgcttcaaaagatttcaaactgtaggcatgtgacttgtgctaaaccattcagaaatccgtggcatcctcactacttcataacagagtcaatattcattacgtgtgtgtttacatgggtagcactgagtctcattggctggcaaagtggcacaggtgtacatactatggataatatgtgtgcttatagataatgatatggtctaaaatgaaactagtttggtctaactcgttgcttgtcaactagggacaaaattgcacttagcagtgtatagagacatttttgattatcacagctggaggcaagtggtgggggtgtcactgacatctagtaggtaaaggccacggatgctgctaaacatcctaaatgcacaaatcagacacccatctcaactgtgaatcgtcagtgttgttggcccaaattgtcaatgttggtgaagctaagaaactctggtctaccagatgatccaggaaatgctatctccccatcttgcccattgagtgcttttcaacagccagaagcaattgcttcctttcagctgcatattcttgcttccttggtcccttcattgatggttccaaaatctgtatatccaaatgctacatacctatgcagctgtctatcagttacatttatcgagatgtccaaccatctccttacatgaaatctgtgcaaaatgaaattcattgccatctcctgcctctgactccaacctctttcccaccttctttagtgccattggccttcacctttcagtcacccaagctggaaaccttaaacaagccactcctgactcctcccccttcacagttccacacaccacccaattctgtagatttttagctcccacaagacttcggactctgatatccctctctgtctcctttgtttcctcttgtatggctgtgttgactggaatccacgtaaaataataataatggtttactgctattctcctaggaagtatccctaacaccagtctctctccaccctgatccaacttccacattgccaccagggaagctgcatggcagcatagaaaaagtgagggatctagaatcaatagacctacatttcaaacccaggtcttcctgcataacgcatgggatgcaccttaacctcttgaaaccacagatgtaaaatgggactaaaagcctcccccttacaaagtggtcttgaaggttaaatatcacatataaaaatcctccagcctaaaccctggcacgcatggttgctccatatgtttcaccgttatttatctttgtcattattatattgcttctaaagtcacccttaacattaaacaactgcagtttgtaaggattaagttttcattcccaaatgccttaaaccttcaataaactgctcctagcggactgtggtgagactgtaaattctagctggtgaccaaccatgactgtattatttctcactgtaaccactgtgcatcgagtacatagtaggtgctcaataaataaataaatgttaatcaagtgaataataaagtattatatacattttattatatataacatatactgtcataaaagaaatattttgctctatgtataagctggaattattctttcaattttttttttctaatacaatcctttctgaagtctgcccgtatccacctctctctgtaattaatgtctcctctctgttctaactttcagtctgtcttgtgtcacctattttttgcagctggtctcgtctgcttccaacagactatgcatcactttcttgccatgaacctatctggttcccctttatcagtatttcccttactccaatatacacacatatatgcacacagattcacgcacatcagatgaactgacagatttttctcattattcttttttttccagaaacttccatggctacatggccaaccaatttttcacttgtgcatccaggcttgtaagttctatcacataatacactgaaagaaagcttcatgtcacagagaaacagcattcctatccccaagctgactggaggaagacaaaaatttataatccaaatgagtgagatgaagtaaactcagtaatagctagattgggtcagaaatgaacagctgcttccagcatgggcagggccaggctggcccactgtacctgggaaggacaggttcacatggtgcttgggtccagccacacagcagagcagtcctgagctcctagggtcaacctgttccttccttccaaggtctttccctggatctactcaggtaatttcctagctgttgagaagacagtgaactcaaaaaaaccattgttcctgggtgtggcaggctcatgggtgggcacatgcacacacggttgacccttggctagccaaggctttttggatctgagttccccatcttccatgtcatctggcactctgtccccagacctcagagctgctagaatgcacgataaaaagccaaattaaaagttgtatcaagtgcaccctagactgaagaagccatgtggcttttgaaatggcctcacttcctccccagagtggcttctttctttctaccttctccttgaagactccatactggccctgcctaggtctgcatgccttcctccccggtctccctcagggcctcttgaagctggcaggcaaagagtcgcttcccggtaggtgcagttggcacgactgcaagtgtacttaaactttgtgtctgatcaagttatgtgtattggatctgaaaccagttagtcaattcgttcaggtccctaagtggcgatttgtggtaatgtctacatcaatacggacggagcggtttgctagctggtttacgtaaagcaaatggctgcaggaaagagggggcagcctccagcattctctctgctaatgaagatatggctggaaaagaaaggaaagcgagtggaaacaaaagtcggcatccatttgtgcataaacactcaggcgaggtctattttctaggttgaatcaatttgcctcttccatttaccccttgtttcttcctccccattggccttctttccttgttgatgcaccgacctaatcattagtattataatcttgttctgtgtatattaaaactccccaacccagggacaaactatggtgtctgtttgtttgttttgatggaattttttgctcttgttgcccaagctggagtgcaatggtgtgatctcggctcaccgcaacctccgcccacgggttcaagcgattctcctgcctcagcctccagagtagctgggattataggcacgcaccaccatgaccggctaatttttttttttttttatttttagcagagatggggtttctccacgttgatcaggctggtctcgaactcccaacctcaggtgatctgcccaccttggcctgccaaagtgctgggattacaggtgtgagcctctgcgcccggcaaaactacgtgtttaagagggaacctggggcactgatacaagttccactcagagtcttacaggaatgactgaaaccagaaagaaaaaaatgagtggtgttgagttccactcgccttgtttctcttttgtatcaatcgtttctgcatttgccctggcaggggaggaaacagcataacagggaatttatttagtgtgtgtctgcatattggctgtatctctttactgctgcagagtacgttgtttctaataattgtgatggattgatacttatgactggctggcagaattcctttagcatgttaaaatattaccttttattccctgatctaatgcataacctgatgtttcagtcagttttcaaatgtaataaacaatttgaaaagcgaataaccctaaagaaaaggaagatgctctgtatcggaggtgaattccattttaaatcatgccctctgccagccaagtgaactccttagcagagttgttctttagctctgatccagtcaagccatctaggagttggatgcaaacgaaagaaattggtgcacatgaaatagactaaaatctgtctgacaaaaatgctttggctaaaatggaacggctgaaatcctccttgttctggtctgctaagctagccaggaaatagcaaaattccaggctcaaacctgagaaagtgtttcctcgagtatggcttctgccttcacctgctggctggagatttggcccttgaaaatggcagttttgcccttacaatctcacctcaacacgctggtccctaacatccctctggaaattttgcccctgaaaagacgttaaggctcagaagcttaccaccatcacctctgacccagaaacaaatcttaggaccttgacaagacgcccatttgacatggcaaagatggaccaaatggcttagtggccaagtggctaaatgcagacagaacacttcatatccttcccctcatcaatgcacatttctgaaataaacagcttaaaactgcaggtcacatgaatttttatttcattttgttttcttgcattttaatttctattctttcctattgtgggttacatcacttttcatcacggtcgtgctgcagaaacgtagagcacgatttatggagccttaacataaatatgatgctagacagaaagagagcgacatattagtttagaatttgcagactcgcacacacggagcacacatggctgatttatgaaactgagatagcctataaatcctaaagtaaggtgctgcatccataaactcccaaggagcaagaggcagtgccccttagcacaaactccagttggaagcccctaggccctgaaaacaaaagacgcacccaatgcttggccttttgcttttcttagaaacacatcgtggccgggcgtggcggctcacgcctgtaatcccagtactttgggaggccgaggcaggcagatcacttgaggtcaggagtttgagaccagcctggccaatatggtgaaaccccatctctactaaaactacaaaatttagcaaggcatggtggtgcgtgcctgtaatctcagctactctggaggctggggcaggagaatcgcttgaactggggaggcagaggttgcagtgagccaagatcgtgccactgcactccagcctgggagacacagcgagactccatcttaaacaaacaaacaaaaaagaaacacatttttaaaaattagccatataccaaagtggtgggaaggtttgctcttcaccaattaacgaaggatgggtaaggaagttagttggtggttggactctgctctcagattcaaccctccctagccttctattctcctccatattctgtggggcggggcttcccagtgcaaactatatttcccaagagctctcttgccaaatgacttctgcctgggatttgccaaatgggaggcactgggaggagtctggggggtgggagtgagggaggagccaggtaggaggcttcccctcgcctcctccctctgcgttgggtggcctcacaggaagttgctgcttctcctccatgatcccagctttgtcagacagccttcttgtgattccaccttccaacaggtagccctggtttctgggctctgtcccaccatctcctccttttgttccttcaggctgagggtggtcacagcttcctgctgttactagtctctccagtgtctcctcctcccccgccacaccacaccatgcccatccagtgcctaacccttttaaactaaacccatattaactttcctgtagaaagttttatatataggttctgccttcctggccaggacctgactaattcagggggaccctggaggctattccaccatctccgactgacaagcttatggacaaggagcaaaatacaaatctgcttccagctttaaccagtcctcagccactcaaaaactgtctgacaaaatcactgcaaccaccaaagattacacaatagcttgattttctcttcctcttggagaaagactcggttgtgggtctcatgaaatactacttgaggtcaggtgcagtggctcacgcctgtaatcccagcactttgggaggatgaggcaagaggactgcttgagcccaggagtttgagaccagcctgggcaacaaagtgacacccaatctctacaaaaaattttaaaaattagatgggtgtggaagcatatgcctgtagtcccagccactcaggaggctgaggcaggaagatcacttgagcccagggggtcgagactgtagtggacaatgttcacgccactgcactccagcctgggcaacagagcaagaccctgtcttaaaaagataaaagaaaaaagaactggaaactccctgggaatcctgggaacaccagaagaaggaatgggaccaaaggttgaaacgctcccaaagatatgggtagaaaaaggtggagttcttcaatagttgctggagaaaggagaaaggattataaggattacaaggtgatgccttgtaatatgttatcactcttttagaaaacaaaaagttgaatagatccagagcttaaattgcttatcctaattcaacttcaaaatcccagcccaatcactctttcaacctaagttataaataatttgacaacttggtggtgtagcattttgcagccacttctctgcaaactataaatgcctgtaaaataatacatctgtgcaatattaacaatggccattgcttatattttttggtgcttcatgtaaacattgagttgtgagttcctttcttaggcatgctgccttctaaatgtttttatccccttgtaaaagcgtaacagaaatggtgactccccccatcaacactcaccaaattttgaagaccatagatgaaagatagaaacttaaaatatgcaaaatatttgctccaaattaattcacatggatagaggttagaatggtgttggcttttggtagggaaacattgggggacatgtgggagctttctggaatgacggacatgtttgacatcttgatgtcagttggttccgtgagtgtgcgcatgtgtgtatatgtaaaaattaacctgtaagctgtacactcaagacctgcactgtttattatatgtttgcacacatcaatgaaaaatgtcaaaataatcatttttcaaaagacctggaaccttggcccctgaagagttgaagaaggaatttctttatggaaaagcgatagcaacagcatctttttaaagaaggagcatttttatggaatttggcaatcattgtggacacacaagtgaactcagggagtaattattggctagcagagagccaagttcatcaacacctcctgggctggggtaaagggagcaggattgggtagcagaagaagttgaattacggtgcagacaaaaccaaggcctcatctgagccgggagctctcgagctggaatgcaggctgtaccctggggaagggggtttaacctggggcaactactaaaaagaggaccttattgagagcagtcagcctccaatatttccaatagctgggcggggcagggagtgagtgcttcggttctgatgtgggagatggacttggatggtgctggaagattccacaaggtaagaagtgaggaacaggtgccactctcacccataacccattccccaaaatgtgtgaactatgtgtttatgagacctgaagtggggttggactcatgggcaaaactacagaacaagtttatccaaataaagatctcatttagcatcccaggtagcaaggatatggagcctgcaaataccatgcatctaaagagagctggatggcctgtgggagaaactgacaggcatcctctcagtccctcaggtcctttgcctcctctgttgggtcacagacaacaaaagacaatggaagctgcagattcacccacccaaggggcatttccttcagcgccaccatgccagagagagcggcaacttcccacaggttgcaaatgagtccgcgtgatggggacgtgagttaattagtgcacttgggtttgagaggtgggtaacaagctgccgctctgcatttggtggttccttttccgaacaggtggcaactgactgacgggctttctctgaagtggagaaggacatctgtgttttccatattgcggaacaccggatctttccaagtcacacatttgggaagacagctgaattgccttcaagttcctcctgttatggtacaaatacccacctggtgtgcaaacatgagagacgcagctttacactagaaccaatgaaagcaaatttgagaaaacccaactctttaggaatggagactacagatgtatgaggggatcttaataattaaaagaagaaaatatgtaaacaggaaaaatatccaactgtcacaaaactctacactaaatcaaactgcaaagttttgtctttttaaaaatatagtcatgtgccacatgacaacgtttcaatcaaggaggggctgcatacacgacaatggtcctgtaagattacaatggcgctgaaaatttcctatggcccagtcacatcatagctaccaaaacatcactgtgcaaggcactactcatgtgtctgtgatgttgctggtaccaacaaatttactgcactgccagtcatataaaagtataacacatacaattatatacagtacttaatacttgataatggtaatagtgactatgttactgatttacgtatttactataacttgtgtcattattttagagtgtgctccctgtacttacaaaataaaaaatttaactgtacaacagccccaggcaagtcctttaggaggaattccagaagaaagcattgttatcataggagatgacagctccatgcgtgttattgcccctgaagaccttccagtgggagaagatgtgcaggtgaaagacagtgatatcgatgatcctgatcctgtgtaggtctaggcttatgtggtgtttgtgccctacttgggtttttgtttttttgtttgtttgtttgtttgtttgttttttgagagaggggctgactctgtttcccaggctagagtgcagtggtgtgatctccgctcactgcagcctagacctcctgggctcaagcaatccttccacctcagcctcctgagtagctgggactacaggcacatgccaccatgcctggctaatttttctacttttgtagagacaggatttcaccatgctgcccaggctggtctcaaactcctgggctcaagtaatcagcctgccttggcctcccaaagtgctggtattacaggtgtgagccactgcacccaacctgtgccctagtttttattttaaaaagtttaaagagttaaaaaaaaaaaaaagagttttaaaatacaaaaaaaaaaaaaaaaaacctcacagactaaggatataaagaaaatacttttgtatagcttaaacacaatgtgtgttttaagctgtgttattccaaattttttagatagtaagtttataaaggaaaaaagttatagtaagctaaagtgaatatattattgaagaaagaatactgaaattaaatatttattaaatactgtaataaatctaacgtagcctgagtgtacaatgcttacagtctacagtagtgtgcagtaatggcctaggccgtcacactcactcactggcacacctagagcaacttccattcctgcaagctccctttatagtaagggtcctacacaggggtaccactttttaatcttttaaacgatattttgtatataccttttctatatttagatatgcttagatacacaaatgtttaccattgtgttataaatgcctatagtattcactacagtagcatgctgtacaggtttatagcccaggagcaataggctaaaccacatagcctaggcgtgtagtaggctataccatctagatttgtgtaaatacactctacgatcttcacacaatgacaaaattgatgaatgaggcatttcttagaacatatcttcactgttaagtgatacatggttgtacacacactcacgtacagacaatttgagactgtggggcttcgatattaaataagccaactgttttagaagaaaagctaccccagcacatctcaagaaaaaaagcgtaccatacaggctctcccttattctggaacttttaaccagtagcctccctccctactctgaatgtgttttgagtccttatgatttatgggtcaccgtcaataatcaaagccattgctggattgaaactgacaatcagatcaggcatctaaattaaacaggaatacaagtctctttcgaaggatccattacacgggaagaattccgctgaagacaccacaacatttattgagaacatcttagagcaggactcaaactgcgaacaaaatggaaaatgtctcaaagagctcccaaaattaattataaaaattaaaagaaccctgaaagaaaagctgctgtgtggagaagatggaagctcagtgaggcagctggttctccacctttggaagctgttcctggcatgataggtcgtacccaacgtctcgtctgtaagggggtgaggagccgacagtagcctccttacctctctggggaaggactttgcagaggaaaggtttggttaatgttatagaggatttttattttttttaaaacaaagctatttgtttactttgataatctgtgtctcccacagcagcgggttgtctctttttttttctgtttctctccaccaggaggtaaacccactggaaagtggttaaaggtacagcattaaaagttactaatcgggggtgggggaaaaaaagcccatagatgaagaaacatgttaggccatcttgaacgtaaatgcgagcttctaaaagaaggctaaggaacacagctttggaaatgcatactttttttccgttggttttctttgacaaaatctggcgacctgtgccaacaagacctgccaggcagtgtcagattgaggaccatggaaacttttaatgattaaaggtattggttaagaaacttggaaaggccaccattgcctacattctctttttgacgaggtcgtcatgctgtccttgtaactccttgccccagtaattgaccacaattaatagggtcagaaatgggcccctgatcccaagtcaatcataggtactgggacagtggcccatgaagtggtctggcccaaaatgctgtcctgtcctgcatggtgtctaaccactccaatcctcacttgtggagaatgtggccttcagatctacccagggattccaaagatggtagacagtacggagctgagaaccacactaaagtaagcagagaaagagatcagtggatctctcggacacccagtcttggactcagtggatgtgctggggtgggagcaatggatatcagccgctgaaagagtgagaagatgacctggtatccccatgcaatgaacacaggctgcacacccactagagctactgaatgcccccaaatattccagttctttctgatccctagctgtgtgcagaaggacttcttctcatttccctgggtattattaaaacagtgcctattaactgaggcaagctcagtcttggctccttgtagcctaaaagtgcctccctgattcaccaacatgataactctaaccacgatggcaatccctgttcatggtgcatccactggtgtgccatgtggcttcgtgatgggatgatcagtcccattatgttgtgctcactcggaactgcaggccccctttccagctctctcaggggctgctctaatcagagctagatgatgcatccctaaaatgggagtcagcattcacaccacacgatcggtggcctgtggatatccacaatttcatctccgaggtgtttgtagccatggtgatgagctagaggcacttatctaaatatccatacttagctgtatgcatgtgtcacattgtaacatctatatgtcacggccacttaggtaaatagcatttgcagcccagggtaaatcctcaggtatctgtctccgaggatgtctgcggtgttgggcacactgacaactaggggcttccttttgctttcagtcataactgttcacatagaagggatctgtctgagaaatgtcacatggcttaacatgagacctgcctgcaaaaggagttgaccgcacgtgtctgctcttgggggtggtactccatggcggcacctaccctcctggaggagattgacagctgcacatccattctcctccagttcctgacctgggtcccatggccttcaattaccattgtgtcagttacagtgttttttgatttacctggaggcatgatttcctgaataggggaatgggggaaagaacgcaggatggccctggaagagcaaagatatcaaatgcatatctacgcaaaacatttcgtcagagaaacgtgggggaggcttcctccatgttggttaaatgtaaccaccgaactgggtcaatttcagaccaatgtcaatggattcacaattggcattttttggtaacagttttgacctgtttcttccaaaagtaaaataagaaatcctgaaggaatgaaacgaggtttgtgctcctctgaggaagaaactagggtgatagttattcacttcttcctttttaaaaaatactgttttgctctagaaatagttttgtattccaaaaacaacaacaaaaggtggaaaaggggcataaatggagaaatacgcttactgtttgagtcaatgatggtattaataaaagtctgattaataagtaaacagaaatggaaaaatagctacagtttttttataacccatactaccgccatttctctctttttctctctccctctctttcttttaaatgctccccaccaccctatcccactccccagctttggaaagaatgtatttttaaaaatcttaatgttttctttttttaaatagctatagaataaacagtggctggaggatgatacaccaaagaaggaaagaaacaagtgaactcaaatcaaagaattcacatcagcttttttgaaaggggaaaaccaaaaacgtcaattgcaagcctcaacccccttcttcttccccaaactgtttttccttttggtttatttctgcatcagagtctacctaggtttcaaaaccaattttccattttcctagaaccagccaaatatggagtgtgtgcaaaaacatggtagcttaaaagaagaagaagtagacaattatcaaagggaagagggaggaaggaaagagaagggaaataaagagagatgacacaagggaactggaccagataaagacaaagcaatgcacttaacccacctggagagcacatcggaccagcaaggcgctctcagccaatcgcctgggtctgcggctgggaggagagtccgcatgggttcatttggctgaggagtgtgtttcataaaccttacggtgcagctatgaaagctatcaggatcttcccacgtttcctgtcattccgtggagattggctgctggagtgcttggttgggggggcggtggggagtggaggtggtaggggaagaggatgcttgggttgttgaggggagactggctctggtgggaagtggaatcacacaggaatttattttaagtgcataaacaaaatgaaatgaggaaaaaaagaaaaaaaaccagtgtattccttttgggtcatgtgagagagccactggcaaagatgagggggcaatgagaaaggaagagagaaaaagagagagagaggcaaaaagctttctatgatttggggcactggtgaagcacactgaggcagctggaagattaaattaagtatcatatctgctgaccctattgccatggttaccggacagcggaaaatattcatcaacccgagccttttcagatgaatgtgcttgaaaaaatacaataaatataaatatatatgtatatcctccccgctctgctgtctaaatgcagaacgtcagccagtgcaccacctgatagtggagataaacaaataataataacaaaatgctcgcctccctgagaaagcttacgtcacttacaagaagcagggcgtgaacagtagggctgaccacttgttcactttctctttagctgatctctttccccctacccccttcaatgatgaaccatcctgcctggtttgattacaaagtaaaggggcaattcgtctccttattcctaagaaacctgtccgttaactacttagacagtcactcttaggcgatgactaaagctgaaacacattggaggaaaaaaaaaaaagacaaaaattacatattaataaaatcagaagcccagcaaagtcagggtaagaatgaaacaattctggtctaaaggagccgacacttaatgactccgcaggcttaaaacttgccttcttgctccagctctcagtctcaggatcccagattttgcctctcactttactcccagcagctgacactgtaagactgtcctgcctgccttgaaaagtgctgtcactgttcccaggaaaaacttgaggcattgcagagcacagccaaggagcagagacacatgaatgtgaataggctcatgagagcagaatctttcccgctccatgcacgaggattggtattttgcccttggacattctctttccgtccattcagtatttcttgagttcctactgtgtgcaaggcaccctgttgaacagtgggtttgggatactgagagactcaggggatcacacgacagcggaaggtggggttcagagagagagggaccatgaaattcacttcgctcaaacttcaccgttttgcagacaaagataatagaaacctagagtggatcaaggatttgcttaaggtccacagctgtttcactgcagactagatcttgcagtctcctaagtcatgcgcctggtcagatctgaaatgcctagatttttaacagcaagtttatctatctttccaggaaatgctactagtttcaaaactcccacattgccacctggcccggacccagtatgtaggaatgcctaagaaatctaacggatgagctcttccccatttttctgcctcacctccctctacttccctttccttccctaactctgtccccactaagataaacagcatatggtgggaaatacagtcttggcttccagatctccttcccctattgaataatcaccttcttaggttaatagagtcccacggaaaaagttgagcagacctaacacaaagttcatgtatattagccagaatgattctactctgtaagaccagagcaggtctccatgtcaagcctggctctgacaccccctggccaagaaccacaggggttcagatggcttttctcttagttaagccttcaccacatgtagccctgaccgcgaccaatcagccttctccttctgcttaggtgcaattttacacagtaggtgacattaactcggtagctgagtccccatgtgcaaccacggcaaccacagggtcccagcagatgacaggagacagcaggttgtatgatcctgtaaattatttccccatagtaacggcaagattacacactttaatatgcatactgcttgagagagccctcttcctggctgaaccaaagcgataatgcatattttgtgtctagaaatccattctaaatggtgcggcgtgtaatagacggtattacctcaagggctccaacctgacccttctcatctggtctcttccaccgacgcataagtggaatgcgtcttccttcgcacaacctcctttgtctctgggttctcctgttttctactgacactcttgggacgtattcaatacccagtccagttttagcaaggctttttgtcctaatggctgcctatatagcttttctgattcctttagataggcacactctgattcaggtgttttattttgtggggagaagaatgaaactgtatcagtaaagaggaagagggaataaaatagaaaaacgaggtaatatagaacatccggaatagactgtgcttactgtatacacataggatagatactgagtttaatgggctgaaggccagattcctttaagttcaatacaaaatacttcccaccccacagtgactcctagaagaaccatttaaaccaggtactttgtgtccctcccttggatggacacagtggaaagtgtactggagtctgtaccagaaaatgcgtgaaattcagctctgccacttttttttttttttttttttttttttttgagacagggtctcactctgtttcccaggctggagtacagtggtgcagtcatggctcactgcagcttcacattcctgggctcaagtgatccttccacctcagcctcccaagtagctgggactacaggtacacgccaccatgcctggctgatttttcttttaatgtttttgtagagataggttttcattttgttgcccaggctggtgttgaactcgtggcttcaagcaatcctcccaccttggcctcccaaagtgctgggattacaggcaagagccactgtgcctggcctctgccactttttacctgggagattacagacaaacttttaacctgtccaatccttggacaccccgtcaataaaatggaatcattataatgagtttgcacaatttttgtgagattagaatcgattagtacctagacataaaagatgcttaacaaatgttaggaccaaggcaggggggcaaggacaacatgtgtgatcctcttgaaaatgcttaagattgatacacggtattgatataagatgatttccctcaaatgctcattgatcctattagcaaaccaaatccattgcaatctgcgtggcactccaggaatatcaaatcgaggctcacagagaggttagtgaatttgttctgccactaggatgctgaattatttttcctaggcctcaatgccatctgtgaaaggggtgagatgataggctatgtgcaagcattaaggtttggggtaattaacttgcttctggggaaaatgtttaactatgaaataaagttagatccagtattgactgccctttttgttgctgttcctctttactcatctaaaaagaaggaggagaaagaggaggaggaagaggaggaggaggaaatgcttatttctggagcagcaataagcatgttccagaaaaaagatctgggtataccaccatggaatactccatgccagtgaaaggatattatgcttcaagcacagacatgcagctcttcagcactgtcattacacacatgtgagttaggaggagcagagcatgaaaacaaatcttttgtgtgatcacatggaaccagttagggaaaatagtgggagctgaactttggacaactctgaatcatactcaattgattctccatcatccaacaagccatcatcaaaaacaggcaaaacacagcccagagagaatagtacacactggaaatatgagcagatgcagtggtatatattattgtccagacacgaatgaatactgtgacttagtgagacataggccttaaaaggcaaaaatagaagcagtgtgtccttctccttctttgtcaaaggaggctgtgtctttgacacttcaaccaacgtaagaactgtgctgagtgtctgtgatgtcttttgaatcaatctcaggaaaaagatatccctgtactgaatctacaaagcctcaaatattaatacttaaggcaacttttagactctttgatggctagagaaattcaatggcaatggaccaaacccatcccaaatgcagtgtcatagagaaatgcgtgtgcacaaagttgatagtaattaatgagaaatttccaaggtcttccctcctttggcatagctcctttgtctttggccttgattctcatagaagcaagttgatcacaacggtgactactggaatggaatgctttcacattttggctttgacaattacgttctttctttttaaaatgccctttctcctctgccacctatagccattaaaacccagatccctctgttttgaaaatggcaccacctcactaccatgtacccggttctcatctcttcttcactatgtttccctaccaacttcccttctccccctccaccccctaaacaatccatcagccaggcccttcgatgtctcctggcctttttgtataaaagtcacactgcacagttctgcatgatgtgggctctgactacatctcccacttcccttcttaccactcccaccttggtccagacagtttagctttctttccctctcctttttttttttttttttttttttgagacaatttcactctgtcaccgaggctggagtgcagtggcacaatcttggctcactgcaacctccaccccctgggttcaagcgattctcctgcctcagcctcctgagtagctgggattataggcgcccaccaccatgcccggctgatttttttttttttttttcttttgagacagggtctcgctctgttgcccaggctggagtgcagtggcgtgatctcggctcactgcaacctccacccccggggttcaagcaattctcctgcctcagcctcccgagtagctgggatcatagggacccaccaccatgcccggctgatttttgcatttttagtagagacgaggtttcaccatgttggccaggctggtcttgagctcctgacttcaggtgatccacctgtctcagcgtcctaaagttctgggagtacaggcatgagccatcacgcccggcctttgcctgtctcaaacatgctcagcatcgtcctttaggacagctgcatgagttgttccctttccatcgaatgctgttttcctatgagcttggtgtggttggctccttctcgtcattctcatcttggctatgtcaccttttctgagaagacacccctgatcagcaaatctaaaggcatcatctagccacttgcaattacaccactctcttctaattctgcccatagcattatcacaatctgacacttgcctgtttatttattttcttgttgtcttttgcctcactagaattttacatttctccatcagagcagaaaccttgtctacagtgtttgccactgtgtccctggcacctagataaaagggcttaatatatttgtgttgaatgagtgccccaaccctaatgccagcatactttattacttgctattcattgtctatgacatttcatatggaccataactataacatcaatcaaatcacatatcctaatttttcatccgaggcttcaactaaaccatgaaatctgaaggatatagactgttttgttcactttgaactatttactacaaagttaggaaaattacgtagggtcaccatgtactgatatgtaggtgatacactgaacaattccaaagggagaaatctgtatcactgtgatgtgaatagcagcatgtggtattgtgcagtatccaacctgagcaaccatacagcagctcagatttctctttaacaaggaggtaaatcaggaagactttttctttcacctcttgttctaggaagaaactcagtgttccatgtccttgctctggccaacttctccctaagtccacaccttagggtaacaaaatccttaaagaaagacctcagtggactcatatagggcaactcacacgtgctgtggcacatctcctctaccctacagtctattctagcaattaatgtgatggttaattatgcacaggctttgaccagatttttgcaggtacaaccagacagggctttgcctttggatgtgcctcatacctctggctttgtgccttgtgcttctttgatgttgtcagatgaggtacctgtaggaacctgttctgcattcaggcatggtcacctgtaagttggctggctgagaacggaagttaatgaaaaattgcttctaccttttattatctgggtaaagagctctgagactgattttgaaaagttcctcgcaagttccaggtaggattcagtactattcactcatagcagtggccaactcaacaatccaccctggcactggccttcctctgttctatgtctctttcccaccatgacctcactcctatcatctgagatcacttcccctatcagtcccctgctctgtttctagggaaatctaggccaagacagttggtgccaggcatggtgaaaatcctgacatgcagtagcatcccagtcctaagatcctcacctgtcttggaaagtgataaagtatgagcagaaggtggactatgaaattctgtgctctctgtgaaatgtgcacagccttaggaaacggtcattacaaatatggagttgaatgacttctgttaactgtttttgaaaaccttgaaaaaatgataaactcagattggataactatcaatccaaggtagctgtgaaaaccaggggctctctagggcagcatttgaggaggccttcatttccaacatggcagatagagcaaaaaaccaggccaaggatttcactttgagggtagaagggtggcaaaggagatgaaatgcacagtcttagcagggctcctatgcccaagtcaggattctgaaagaaaaagaatgagactttgaaacctgaaattcaataatttgggtagatgatcctaagaatcttgaatttctggacttccttgaacctttaaacctggcaaaagcaacctcccctcacctagactcacctgcaaatacccaacatgagccaggttcccgtaagatcatgcttgtggtccccaaggctcatcccacaacctttcactgcctgcaacccgataccagggttagatctcaggacgactcaagtggagaaataagtgtctgccctgggaattaatagcttacatgctgcaggaacagccggacacgggaaatgtggaatgtgagtcttccataagaatggattggcctggcctggtggctcatgcctgtaatcccagcactttgggggaccaaggtgggtggatcacaaggtcaggaggttgagaccatcctggcccacatggtgaaaccctgtctccactaaaatacaaaaaaaaaaaaaaaaaaaaaaaaaattagctgggcatggtggtgcgtgtctgtagtcccagccactcatgaggctgaggcaggggaatcacttgaacctgggaggtggaggttgcagtgagccaagatcactccactgcactccagcctggcaacagagcgagactccgtctcaaaagaaaaaaaaaaaaaaagaatggatctatacagaagtcttctgtggaaaaaaaaaaagaaaaaaggtaattaaaacattttttttttacagaatggatctaaagggtattggaacagaacagttggaaaaggaggcagatgggcaaagaatttaatggaaaaataaggttccattatgactcagggtttgatggtctggcaaagatacctggagccagtcttagtacctgcctgggctagatcttaaaagcttggccacggcaatggtctgtagtaaacaggcaagagaagaagaactgcttttgctttgcattcaggaaagtgtcagagggtcaggaggtgggaatgttagaataaatttattatttgagaacatgaaacccactacctgactatgttgcctgggagggcccagaggacactcccttcactaagtcaataaggaccacactagtgaagcaggcaggcactaacatctgtgtgaaacccatcggtggctgacctctgtagatcagggtggacaaatggaaatgccatcatagaagagggttccctagtttcaatgaggataatagaattctagaatagcacaggccagatagtggtacataatcactcaaggcagagtggttatcattactgtaatggctggcaaggctcagctggcaaccagagatctctgcacatagatgaaaagcatgttctgatgggtgagacagatggacagctctttgaaaaggagtccctggtgtgaaactgaacactgaccatggggctctaggtgatgatgtgactgcagttaccactcagtagctggatattattagagcccttgagtcataaagttgagtaggcaaacctatatatcatcatataatggatatggtaggaatattcaggatcaggcctgagaagctccagaacaggaggccagatcctcatgttgactgaatctgttgcactgacacctctctcaatgcacactaattgtcccaaggtaggagcattttcctatgaccaactgatggagaaaataacttggggctggtttacagatagtttggcaatatgttgatgtgaactatacaggatctgatagcctccctcaagggcagcccacaagataatggtgatgggtaattctttcataatgcagagctctgaattgtgcactgggtcctcaatttggagtgaggataaaacggtctgagataaagatttacaaagactcctgagcagtggcaaatgcctcattggtcaggagcctggaaggaggaagattgcaagattgaaaaggaggaggtctgaaaaagagacttacggatggacttatgggaataagcacaaagcctatggggttctttgtctcatgcccaccacagagaagacgctgaacaagcagaaggacacagcccatggactgtcagctttccttgcttcttggctatgccagatgattagtttcagagaggcagaaagggttggtaacgcagaagaaggctgcacaaagaaagtgatattggaggccatgtgcagtggctgtaatcccagcactttgggaggccaaggcagtcagatcccaatgtggggagatcaagaccttcctggctaacaccgtgaaaccctgtctctactaaaaatacaaaaaattagctgaacatggtggcacgcacctgtagtcccagctacttgggaggctgaggcagaagaatcccttgagcccaggaggcagaggttgcagtgagccaagattgcgcccctgcaccccagcctgggtgacagagcaagactccgtctcaaaaaaaaaataaaaaataaaagtgatattggagctacaagagccacagtgaaggatgagtctgtatttgttaagtgaatactattattaatgctgctgctgctactattaataatagtggctttcatttatttgtggttacgtgatatgccaacactatgctaggcattttatacatattttcaaatttattcttcacaataactatgaattaggtcccatcattattattattattactttatatataaggaagctgaatatcctgaactattatttttactattctcattctataattccaatactgatattagttactattggttaaaaagaacctgtgcacctatcatctcatgtaaccatcataactctttgagatacgtgttattattcatcttacaagtgacgagctgaagctcaaagaagccgaacctctgccttagtgaccaaggtctccttgatctgagactacctcctgctaaagcactctatgtctgtcctattcccttcctaaaagtccaaggaggaaggctggtgaggggtgggtgggccgctgagcttggtaaggttgttacgagtgaatgagctgacatgaactttcaatgtgcctgacctatttaccaggatccctatcccagcctccctcctcccatcttttcctctctctcccccacatatgcggtgataaacaactgagctgcccttagccatttttacaatattgatatttccatttcttttttctcatgaaacaaaaggacttaagttttgagaaataaagaaataaaaagaattctagcatattcattacaaggtatgaatgctccttcccagaatgtttagagtcttgcacaggccaggaaatgtgcttcctgaagacccctgtccacacttttatctgcataactttcattgacctaaattgtatttttgtgtgcagaagggcagcccagtggaaacttaacaagtcttctcatctttctgttaaacttcctcagttgccaattaccaattctgtgcactgggggatgtgcaagacacaccaccttcaataggagcaggatgtactggttaaggatgaccaagtcaaatatgtaaagggatcccttagtcacaaagatggtgccaatgtggtagggcttaaactaggatggagaagcagatggaagggagaagaccagagaggagaagagagaggagaaagagagagatagataagagagaggaaaaagaagaaacagagaggagagagagaaagagagagaaagaaagaaagagggagagagagagaggaagagagggagagaaagagagagaaagaaagaaagagggagagagagagaggaagagagggagagaaagagttgaaggagaacaaattcaagaacctacggatatagtttctttagaagtacgtaatactgaagaggctgaaaaataattccttgaaatgatttatggctagagggaatctgggatcatttaaaatctgtcatagaggaatctgggactctatttaggagacgtttcttggagccgtatctatatctcaccattttgatcatctgaccagctgtttaaatgcaatgattatgtggctggactgatgggctaactcagtcaaacaagcccatctggaagatgatgtagagtcagtcaagatattatattctctgtgcaaatgcaaacacattgtttccattggtcattgccattcatggaatataacatggaacaaagtaatccctatgaaatacatttatattcaaagacagagaacaggggaaaccatgtcagcacctctgtcgctaactcttcaccatcatcattgaacactgacccatgggttcttttaagaataccattccatgagctatacaaatgcattttgaaaagctacacaagtcacacgaattgctaacgctaagtataatcactgcgagaaaagagaaccacactaaatcgcctcttagagttggggctgcacagcgggacttagagcagcatgttctttgtaaccagggcttacatcctaccgtggctgatgtccatagaactgtagagttagaaaagaaaatacgagtgtgtgtgtgcatgcatacacgtgtatgttaaccgcacataagagatacacaaactcacatatacacaaaaatatattcaagtacccaaagtttatccactttaccttgtatgcaaatttgattgtttaaatgttctatattgtgacacatgagatgtggctgcaatagggtggtgattagaagcttccagtatcgcctcattggatttaaggcttagacatacctccagctcagccccttctctggaataatatgtagggaactaggtattttcatgtgagaattgaacctcagaaccaatataccccaaaccaaaatcatccctttctcctctaatcaatttcttcttccttcgttctccattgattttcatcacatgaacccaggagtgcaggagctctgtctgacttgctcatgactgtattcccaaggcccagagcagtgtctgacacacagtagctgcacagagagtatgtgctgaatagtttgggtggatggacattgaagtcactgttctccccaccgtggggctcatcttgaatacttttctgtctagttatacatcaatgtctgtcatttctttctttaagaggtgtctttgcatttgtttacctcactgtgttgatacatgagatcaagtacagaaaaacgcatgatcaacaccgtgcacatttagggtaattattcctttcaacttctgcctgctagcaccctcgttgaagtcttcatccccccataacaaatccatcaggctgagcgggtctgttttccttcagtctcgctttactgcattcccatattcccgttaaagtgataacctccaaagcgccgtagtgactgtattgttctaccgtccatcaccttcaaccagaagcttcctgtggactactaaattccaaagcaatctaggccatccctgtttggggatctctgcatttttctacctctatggctcactcatttcctttgcactagaaatatttatcatctcatgctccctcaacagacttggccatttctaccttcatatttttctccatatccatctacaaaattcatggatgaataaatgtacagatgaatgtcccttctcattgacctttgcaaatcccatctacctttcaaatgccatctctaacactacagttttcttccctcactaccccagtttgagttagttgtttcagtcaccaggcaagaaatctgagagcatcaaatttatttgggaggagcagggaggagcagcaaagagtgaaaccacaatgaggaactgtaggaaaaatattagaaatgtagcaaacatagtatctttcaactatcccacctatgaggtgagggagctggggtatttatacaccaactcctgacagttattggtagagggaaaaaggagagaatataaattcccaatcactttaatctggtataacaccagaagcagccctcaggtacagcgatgtacatcctcagttgctcaggtctaaagcagtgttttctaacagaaatatcacgtgagtcccaaatgcaacctgcatatataattttaagttttctagtagccacattaaaaaacataaaaaaataagtgaaattaactttaataatgtgttttattattaattattgttgtacattttattcagcccagtatattacccaggttactattatttcaacacataatcaacgtaaacaaattattgagatgctaactttctttggtgctaagtttttgaaatctgcaatatattttatactctacatatctcagttaggactagccacatttcaggtgctcgttagccacagagactatggtctaccatattggacaggtctcagggatacaggcaggtcacttaaacatggatcattgctagtcactgagatcatcgccttctttcgctggactacttaaagtgctgatctaagactcagcatacagtgtttagaaatgttatttattttttcatgtagctaggtcttatttccctgaataaggacatatacaactaggatttacttctgttattttcccattagttccttttttattgcctggttcaattaccctttgccaaatggcagattctgggaagtcaccttatccacaggtccctaacctttcatgaggagaaatcatcattaatttcccattcaggggactgagaggagatgtgtcagtccaaacctcagcagagagggacagttagctcctggtctgacagggggaagactctgccccgagcaagacatatttaaccactatgcagacacaggaattttaaagacctccaaagagggagatacagcaaactcctctaataacaattttgagcaaatgctttcaggttttgccgaaagaaaaaaaagaaacccatctatctaacataaattatccttcggctgctttttccccgttctgccgtattgcctgcattcatttctgagtccaacaaagtcttcgaaaagcattggataggcacttggtgaccagtttgccattaaaaggttaacatgtcttcccagctaaacagaacagtggctattatgccatggaatgaaaagcaccaagagagattcgtggcacataagaggcaaagcagcgaaggcaaggagattttgcaaagtccaggaatgtctcaaaggcactaagtggtattcactgtctactaatggaaaatgtgaatttcccaagtcatttaagtaagcagatagatgtaaacatttccaagctcatcaacttctcgagaataaaggggagatctgctgaattccagacggttgaaaatgacccattcttcttgatctgaagcccaggaattttctccagtatttctaattgatggttatttatgacaaacagttaaaccaccagtaaatcagaagacagaaattttccattaaaaaaaaagatattttctacattattggttataaacccatttcttcttcagttatctgggattaaacattcaacatttaatcagtctctttttaggattattctataaatttttaaaatgtttttctacatatctctaaaatacctatttatttatcaattattatctgccttgtttttttaaaaaaattcttccttattaacttcctcccattcttccctaccttgggcccgtgattcattctcatccataagttgtcctactttcagaatgatgtacctttgagctttgtaccttggttgattggaatttctttccgtcccattttctacctcccaaaggagaccaccgttctctgtccctggttcttcctggtcacatgccacctgtcttgtctttttattcttgcttcatcagagtctctattcccagggacttcaaaggttgaaggttccagaaggcagcctcaatactcctgttaggagtactcccactagaggggttgaagtgttaccattccactgacttctacttcctttaccaggggttacttgcctccaagacaccatttgattagcaaaccgtactcagatatggaagtggcattgctcacaaactactaggaattaaggtcgtttcatttttcaaaacaaaagtttctaggaaatgaagtatgtttactagcagtgtaattggagtgaagaaaacttatgcctgtttttttagaaattaaaattatggtattttaatatgaggcagatcacatatttaaagataaaagaatgtatggaaactgctgccatttggggttggtttaaatagactcattgtaaacttgatttaatttcacaccaggcactttttcacaaactcaagtttgaaatagaaaaatgaggccttctttaagataatgaacccattttcaaagtgttgcttcaaatctcactcttaaaaagatgtaatggaatatacttgggtgtttctacaattgtgatgttttatgactatgtctaatccctgaaatctcattttctgaactttccataaattgcaccaaattctataaattaaaattggaattatataatcctttgtcttcatctaagatgaaaactaaaattacaaaggcatagcctagcaaacttaagtttttctaaattcatgtattaagtaaaaattaactgtgagcttttaccagatgaggaatttttagaaaaattatgtaattatgaaataattgtcttggtaaatttcagtttataaatgttgggcttctttcaatgggcttagaggaacagctgatgcaccttcaaattctccatctggctctctcaccaccaagccctgtctgctctggaagaagtctactgtctcacgcattctttgtacaaacatctggtgtctagcaagcatacatagtagacatacatgaaataaatgttaattgaatgaataaaccaagtcacctatggtgttaaatgcaaatttacacaaaatcaatttaatttaacatatatttatttagcacctactatttacactggaaaaataaaagatgattatgaagacatagattctgcctttgaagagtttataaaataatacagagaaaaaaaggacagagatcattctacaccaaagtgatactgataatatgttggcacagctaatagttctgaagagagtgaagatataaactctcaagcaagttagagggaccaggaaaactatcacaaaacacggtgtacaaaataatccttggacccttcagaattccagaatcctggattcaatacttcagaacatcatcatccaaagaacaaaatcaaaacaaatgaacgaaaaaatctcaaatagccacctgatttttaaggcagttaaggaatcccagccttcaattatcaagcttaaactatgtcttgttgtggctggttggttagttggttggttacccctatgtagcagatttagagctcagatgttcaaaaggttctgccactttcttgtggagcaatctcatccacaagatgcagacaatcatatctaccttaaaggtttgttgtaaagggtttagaatggagtttggcacataataagcttgaggaatatgagctgccattgataatagcaataataataatgatagtaatgatcatttgttccacttagtcactgtgccactaactctgaacctaccacaatagtactggtaatctctcacttgtataaacagataaaccctacagacagggcgggcagggtaggaggtagggtggtgatgtctctgtctcacactgactctcatacttgttctgtccccaagccccacatcactctccttttcgccggtggctctcatagaggccgttgtgagaaaatgtagtgaacgtagaaaggggtggaaatctgggaaaactccaggaattttaagaagaatttttaaataatttaaaataaaaaaatttaaatctaaaataattttttatatagtagcattttaaattttattaaaatgaattttagtaaacaataaacttggaactctgatcaaaatggcagatactcataatcaccacattttttcacttttgcttattataatccctaaaattccaccaatgaaagtagcaatttccagccctgggtccttagaattctgactctgctgaggtagtatttattttcccataataagaaagatttcacaagccttgatgaaaatgtcaacttccgttcccttttgccaaaaaaatagcaagtttgcatggcagccttggttatctaatgatgcacagaagctctgattgtcagttatatatgcctttacttaatgaatataggaaagagaattcattattattccgtcaatgaagtttgacatcacagcatggatgtccattgattttgagcataacaaataccagattttaaaaaattaattgtgaaaaattgggaactgataaatcagaaattcatttgaatttaaaagcatctttaaagtattacaaccatggctggaaaaagcaaagacataaaacagacataatgaacttcctttgaagcattattgtgaagatgaaatacgttctggtcttcttgttcaggaaacgcttgttcaattggattctgatttccacagaggtttctctttgtctaacttgaaatcgggtctgctaaggaatggggggagttcctaggcattttgtgtatcccatatgccattatccatagcccaggatctggtacagaactgggattcgggaaaatggttaatgatctggggcagtgagggaggaggttacttgggagaggggaacttagttgactaagcagcccagaccatgtccaatcccagagcaggaaaccgggcaggaaatttagggcaagagggcctagggatcctgaggacagggtgccctaaagaccacctcccttactgtcaagctgtgccttgtgtctactctgtgccaaggtgtattagtctgttctcacactgctaataaagacatatccaagactgggtaatttataaaggaaagagatttaactgactcccagttccacctggctggggaggcctcaggaaacttacaatcatggtggaaggggaagcaaacacatccttctacatgtggtggcagcaaggagaagaatgagtgaagcggggcatggggaagctccttataaaaccatcagatctcctgagaattcactcactatcaggagatcagcatgcaggtaactgcgcccataattcaattacctcccactgggtccctcccacaacacggtggcaattatgggaactacaattcaagataagatttgggtagggacacagccaaaccatatcacaaggaaagggagtttcactgtgcctttatttctcctcctctctcccataatatgggaacataacacaagacttcttctgaaatgatttgggatttattataatttggcaaatttgttattcaggctaaacgagcaaataaacacacgaaagctctttagcaaagaactcttggaacacagcacctgcttggtacaatgagatctcttcccactccaatttcagccctgacatagttactacgtggtttctgaactcatgaccagatgtgacctccctgggttttatatgctctgctgacagcatgtgatgtgcctgccaccctagaggcggggttggtgctgtcttcctgtgcagggtggccctgtcccatgttctgagttcattgacatacatgggggtatgctttacacccagtggcattttggcaaaatcagccttgcaaatggcccctcaccctggatccttggcatatttcactgcaatttacacagtgctgggggtagggggcagggaatggaagctgggttttttttttttttttcatatgtatattctgaaggaaagaaaggcaaataaagaaaataaaggagatggataaagtcttttctctttcacttcttcctgaatttcccctccttttgttttgtccttgcatctacctcgttcctgttctgatgaaactctatcctttattaaacaaacttacaatatttagatgtggcaattcagacatccaccattgaaaatatagaagcagaggtggttaaaaaaaattccagccaactcactgtgcaaaaggggatggtcaactgattttgaaaacttcagaagaaaagcaaatgaaagtttcaaaatctgtcatttcagtttgtaaactcttccagtaaatagtagccttattattagaagtatatatcagaaaaatagcatcctggcagctctgctgtgccaggaaccatagtaaggggttggcatgaatgttcgcataagggaaggacagtaggctgggtgatttaaatagagtaatttctcatctgtcagctgattccttccaccagccagtccaagccatctctctgtgcacctaccatgtgcaaggcatacaggcaacactggccattttttatacataaacacattcttttcctattacttggctttctccctcagaaagtgacaggaagtccactagaattacagaaatgccatgctaggaagaaccatagagattagcaagtccaaccccttcattgaacaggtgattcttgcaaagttggagtttaagggaggcatcgtaaaacatcaactgaagtcttgcggcctttccatgacaacatatgcacgggatgaaaacagaaaggcagaagggcagaaatcatctttgtggcccttctgtccctaccacttcccaaagagctgtgaaaacagcttgattctcatgttctgattcgcatgttcttgattctcacgttctggaatgaatgaactaattccagcactcaacgcatctcatttctctctagtgtcctactctacggaagcctctagatttgctgtggtaaagaattcaaagatcaaactgatgcagccctggccttccgtgagctccctgcttaaagagcaaacctctagatgcgactcttattagggttagtgtgcaagtggtcagctggtattctgctcttctgccttcagagtcatctgtgtggtcagaggtcttcgttttccatatttgtacacagtctttccccaggtgggctgagggcagaatgaatatttgctctattttcacagagggccagtatgcttgagcaattaaacagaagctcttctcattgtccatttccttcagctaaacactctacacaacatggtcacgtaagaaggactgtctccaggttcgaggtagagctgtgactggtagaaacccccatgccgtaaagacacaaggaaaaaaaattttccctgcctatggaaggcattgctcaataaggagaaagagaccagggcaaaccagcgacatgagggcattacaagtcaagcttcggttttacgtacagttaattctctcccgacctggggagattcctgttggcgatttttcttctttcaggttttagcacttacatttactgatcactaagtcatgtctacatacaagacaaaacccaggacaagccaaagtcacgccactgtatttataaagctttccacacaaaatccagtaacatgtagcttaaaagtagatatggaaagggacgcgatttgtttgctggagtttagctaatgagaagaccctccctcttaattcttgtgcaaactcaaccctatctaataaagtgatgaaaaagaggatctcacggaaaagaggtcttaaaattcacttacttagtttcaagaagaacaaacagaagagaaggggtgcacaaactccgcgtggacatccagtgcttaatttcaggtacagacaacatgcatcttggtacaagggtacaattttagctgcacaccagtgtaccccaagataccactaagtctaaatacaccaccataaaaggtaaaaggatggaagtccctatcgttgcctgttcccctcaggaccagcagccaatatctccccgacctcctagagagaccaaggaagggttcaggcttaatcacttgtacaaaatacaccccttgcaaccttttaatatttctagtaatttttctcttaggagttttgagctaacataattctcaagacacttcccttttaagccttacatcagcagaggcgaaagcagtgtgttcggagacaaaagcaggtgagagccagacacacgatttaccccaagcttctgcctcttggtggccttaatgacaaagcttttaactttgtacaatccctgcctctcaaacaaagacatgattaaaagaaggtggttggggacggggaaggaaataacataaagatgaggacgtgcaggaagccagcttggtccctgtccggcacacaatccattcttggccaggaaaatgattgccgcacaatggccagcgtggccagtccagggcagctgtgagatataaattgtcagcaatgaccataagcactcagagaaacaatttaattcctcacttccgccatcatgggctgatatattctttcaaggtcattacccaaggctagaagggtcgcttgattaacgagtgacaggcccaatgagggccagtgcgctctagcaaggccttatattaattagacagaagctccagaaaataaatgttacagagaaaggaggggccaagtcttgagcgtaagctgtgacctcgccacccccaccctgttcaccccacaaaagataacaccctgaccttgatccttaatgttatactttagcttagttttaaaacctataaaatacaaaacataaaccaggcctcgtttcatattcaaaatgacccaggccctggcctccagttttgacactgtctttgtctcaccctttctcacttagttattctaatttattggttaattctgagcggggatgaggagaactgctggctgtgaacttcacatctcagaagcagcttaaaccatgtttatctgagccaagggaagcaggagaatgatgacacttccagtgttttaagcccagtggctaataatctagcaattgctctttaataaactgtcattatcttgcttaaggagttaaggagatttggcaatagcagtggacttgcagggcaaatgaccattcgaagcaaaaggggcttaaacataccctctacttcttatctagtattcggtacctctttgattacatttactatacagtcctcattttaagagacacaaaagaataaactcctagagaatttagtgaatttgaagtattcctttccaatataagagacaactagtttgagaatggggtttcacttccaccaaccatcaagaagggctttttcctttctccactcacacattcaccattttgatcactgatcccattggaaaagcaatcttgccatctcaggcagctccagcctggctgctcgttgtggatgcagagcaaggctatactatatagtttttttgatttcccagaaatccatcaacgtctattcaaaagagttcaggtggtgaaggtaggaggcttaggtgacactcaggatgtgaagggttgttgacagaacttcccagcaagaggccccatttaccttgcattctgtcaaaaaggagaaaagaggttgtacttttgagacaggttgtgtctatgaactcctatttggcaccaccttctgactaaatactgtacatacagacaggcaagaggcaggtcactgatggtccctctgagagccttggggacctactgtagttgacaatgtctgagaacttctccagtgagtccggtctcctggtacttgggcgcttatgtcactccctccccttgagtataggagggacctaggggctcacttcagtcgaatagaatatggcaaatgttatgggttgtcacttctgaggctaagctactaaaaggctgtggcttctgtcttccttgctctctttcactctgtcagggccctcactctggaggaagcaagctaccatgtgttagctgcccctgtggaaaggcccagaaggccaggaatgcatagctccagccaccagtcagtggggacccaagacctgccaccagtcacgtgtgtgaacttggaaatggatcctccctacccaagccttgaaatgatggccacagccaacctcttgatagcagcctaaagagagacttgagtcagaggcacccagctaacctacataaatccaaactcctgacccagggaaactgacataatagatgcttgttgttgtttctgctaaatcttggagtaatttgttatgtatcaatagaaaactaatacacccactaattccactgatcctatgatgtactgtgtgatgcagaacaattcaactgctctacattttagtatccttttctctaaaatgggagcggcctcctggagagctttgacatatgggaaacatctgcaaggatttggttctgttcgtgggaagggaaattcgatgcattatcactgtattatgggtatttaatgtacactaccttatcagatttatgagttttgtggaagatgtagcatcattatcaggcacgattattacactatattttacatctctgagttatctgtccttgatggatatcaatagcagtactagccaacaaatttgcaaagataacttacacacatattcattcatccatttctccaaccatccatccttctatctatgctttcaacaactatttattgaggatgcaaaaacaccgtaagaggtagaaaaatgtattcaatatggtctatgtcttcaaggagtttacaatcccagcagggaaattaatgcgtggacactaattactgaaatctaaagtagcatgggataagcaatcattagagtagaaaagtgcaggagggagtcggaagggggagaattcagctgtctggggaaggcttgaagaaagcctggaaatatacattaatgctaaggaaatgtgctatgaactcttattcctgaagtagtgacgatgtgttggccatagcctcttgttcagtcttgttttgaccaacaccaaacatttgaagcacagtatcaggatggagttatggtctgtagccagagaaccaaggtaactggcaccatgggaatcacacacaggactgcagcttcatgacaccagctacagtataatgatacattacagaacatcaacctcctggatgcaggacaggcatctggctgtccaaccttctgaattgagaacagcctgtaacgaatccccagttccataacatgtttaacaattaataagctaggggtttccttgaggacaacaaagaataaaatatgagtttgccaagaaagaggtcacacagcataaatacattctaggaaaacaatactcgtgatgaggctagaggtgggcagtttttcctctactttgaaaatagagtgaaatacattgagggcctaaattatctggacgttggtcagtcctgtatttcattccgccagttagaccccttgtatgtttgtgataattttgcccagtggaccgagtggctgctgagggaaaagctgccctggtcaaaggatttgctattaatttcagatatgctcttaaaatgcctctataagaaaggacaagaaatcaaagggtttggtgccaaggaacaggattaataaaaaatattgtgtccgttctagagaagccaattcagcgggtttcactcatgtgatgtgttcaaacagcctcccaaagagagaaacttagcatggcacccacccaggcagggaggttactggcaggtccccggcagcagtgacactcagagacagcaaagacctgcttggctcctgcctcctgggagcctgctgaggtcagctagtaggcttgatgaaactactctctggccagtgccccttgtccaggggacaaatgggaaaatatccgtcagaatctaaagaataattccagaaagagtcatacctctgaggaagtcaatggcactgtaaatttacaccttcacctagatagtaattcggtggaaaatgacgttcaccctccaaattcctgattcagagtgctcgaaataattgtgtcatttgcaagcatcccaactgatgcacctgtttctccgtggcttcattaggggatcataggctgtgtgatgacgcgtagcaaccaggcagcagaaatttcttagaaagtaattccccacatgtgcaaaattcagctctatgaggaagtattttgggtgtgtgtgtgtgttggggtggaaccactccattgtatttgatagttgaaatgtatcgcttgtgtccttggttaacatattagcctgttttcacgctgctgatagagacatagctgagactgggtaaattacagacaaaaagaggtttaatggtctcacagttccacgtggctggggaggcctcacaagcatggtggaaggcaaaagtcacgtcttacatggtggcaggcaagagagagaatgagaaccaagtgaaagggtttccccttataaaataatcagatctcgtgagacttattcactaccatgagaacagtatgggggaaattgcccccctacttatctcccactgggtctgtcccacaaaaattgggaattacagaagctacagctcaagatgagatttgggtggggacacagccaaacaatatgggaacacagccaaacggaagttaattacctcctctaagcagctcaggtgtgaccagtacttccagagatgttttccacgtctgataaactacttctctcattccaaaagttacaatagttacaaaagttacaataggcatttcaggtttccaaattagagttcagacactgtaatatacttatgaagctcccaaaatgatgccaaaggggtctgtggaccccttttgggactccttttaaggagcaagattctacactatgattttaaccctatcaacattcctcaattttctgcaggctttcattgattaagaaaagctcattacaccttctgaggtgctgtcttttatacattttgctgtccatgcacttttcacactgcaacatgattgtttgtgtgcttatctatattatctttatattacaatctttatgaggtcatgcctgcattttatttgtcttcataaccccagtgtctgcccagaaaatacttgacaaccaggtgtggacgtgaattgaattctgccccttggttaaggctaaacatccagttgccagctgggacagttctgcactggagaaacatgccaacatgctgaaaacctaaaagttgtttttatgctcctaacgggagagatgaaacaggggtatacagtatttttggtcaaacatgccaaatagcttttttcttccaagctgtcactatttgttgggaaacttaccagttgcatggctttttagagattcaagatgtcttgcctttcctaatataaatctttgttgccagtctaattggttttgggctcagtcttggcacagccacagccttggccacccttctttgccctcagtgccgctaaatatatccccagtgctcagtatgtccagatgattctcttctaacctttcaggtcaacgtcttttgctatttatatgcttttgaaaacctttcaataataacttccccttcaaaaaacactaatccagaacttacttctctgcctttcttatgcgacaatttttatgcaggaattgtcttgtttttttaattaagaatatttcctggccaggtgtaatggctcactcctgtaattacagcactttaggaggatgaggtggggggactgcctgagctcaggagttcaagaccagcctgggcaatgtagtgaaaccccatgtctataaaaatttcaaaagttagctgggtatggcagcacacgcctattgtcccagctactcaggaggctgaggcaggaggatggcttgagcccatgagctagaggttacagtaagctatgatcatgccactgcactccagcctgggtgacagaccaaaaccctgtctcaaaaaaaaaaaaaaaaaaaaaaagaatatttcctttgatggatgtgaactgcagatttgctatgtcctactgatagaatattgttatttttaggctgtgcacagtggttcatacctgtaatcccagcatgtttggaggctgaggcaggaagattgcttaagaccaggagtttgagaccagcctgggcaacatagtgagaccctgcttctataaaaaatttaaaaattgactggatatgtggcatgcacctgtaatcccagctacttggaaggctgaagtgggaaaatggcctgagcccatgagttggaggttacagtgagctatgattgtaccactgcattccagcctgggcaacagagtgagaccctgtctctaaaaaagattaaaaaaaaaaacaaagacagaatattgttatcttagtagttgatacggtttgtctgcgtccccacccaaatcttgtcttgaattgtagctcccacgtgttatgggagggaccccagggggagataattgaatcatgggggtggttctcccatactgttctcattgtagtgaataagtctcatgagacctgatggttttatatggggagacccttttcgtttggctctcattctctctttgcctgtggccatgtaagaccttcctttgctctttctttgtcttccaccacgattgtgaggcctccccagctatgtggaactgagtccattaaacctctttttctttataaattacccagcctcaggtatgtctttaccagcagcgtgaaaatggagtaatatagtagtcatcaccagaagcagaaatcagtcattcattagttaactctgaaagcatatctctggtacataagaggagggctggaactaagctgcctgaatctgaatcctcactccccacttactaggagtgtagccttagtcaactaacctaatctctttgtgcctacatttccttattgtaatgggaataataattgtactcacctgatatggtttagctctgtgtccccacccaaatctcaccttgaattgttataatcttcacatgtcaagggtgagaccaggtggagataattgaatcatggaggcagtttccctcatgctgttcccataatagtgagtgagttctcaccagatctgatggttttataagggtcttccccctttgctcagcactcattctctctcctgccaccctgtaaagggggggccttctgccatgattttaagtttcatgaggtcaccccagccatgtggaactgtcagtcaattaaacctctgttctttataaattacccagtcttcggtatttcatcataacagcgtgaaaatggactaatgcaccacctcatgatcaaggatctcaaatgcgctgttacgctgccaggccatcagtgtgcttatctatccatgtgctgtctcacactccaaagtgactatgacattttctcgtttcatctcaaaccatcaatgcctcttccccatcctcactttttgcggagggcttggcttcctacttcaccaagaaaaatgaaggattcagaagtgaacttccaaggactcctgactatcacttgtacccatcaaccagcttctgcattttcatattctgccttctagttaccatgcataaaccactcatcctcttatctgaagtgaaacactttacttcatactagatcctattcgtgccaacagaaggctctctctccatctattctcccttcctctcttgcatcatcactaattctctctcctacgggtcattatcctcattctcttggtaaccagatccagtttcatggctttaaataccatctatgtcccaaggagtcccagatttgtatgcctagctcagacgtcccttccaaaatccaaacttgaatatccaatgggctaatcagcatcttcacttgaatttttaatagacctctgaaaatcaattaagtccaactgtttttctcctctaaatctgctcatccctcagccttaggcatttcagttaatggcaacttcatccctccatttgctcaagaaaaaagtactgggaggtcatcttgaactccctctcttttacagccttcttctaacccatcaggaaatcttcttggtgcttcctcctaaatgtacacagaatccaaccccaaccacttcttatctccccattgctgccaccctagtcagtgctaacagcatttctcacctagatcatggcaatagcccttgatctgcccttgctttcgtgctgcctattctcaacccaaaagccagagaaatccttctgatctcatctgaaacccaggtgagatcatgttactcctctgctcaaggtcgtcagatggctcctcctttcattcaaggtaaaagcccatgttcttacaagggcctgcaaggtgatctaacacccacctcccttacctctatgacctcctacttctcttccccttgcccattcagctccagccatggtgaattcttcaatgtttctttaacacacaaagtatacttccactttagggcctttgtacttgcagttctctctccctggaatgctcttctccttaaatatccacaaaggcaatgctttcgcctccttcaactctttgcttaaatatcctctcaatgagttctaccctaaccatcccatttaaaattgcaacctgccaccaactccagacctttcagtttctcttacccttctgtctctctcggctttattccatctcatgcatcaccttctactacatgctataatgtgtaactttatggtgtttatcgtttgtctgccccagaaggaatgtaaccacaaagggatctctattttgctcactgatagatctcacacttttagaacagtagctggcagatattaggtacttgataaatacttgctgaattaaattgcatttggtttgaatgataggtgttctgaggatcaaatgagcttcatatacataaagctctcaaaataatgcacaataaatgttagctgccacaccatcactaccgccatcatcgtaatcgtcacagttgccaaattgtgtgtctgagtctttcttgtggcattttataacatcagatgtaaagacaaatgaataatcaccaggatattttctttgtacataaggaaacctttagattttggtgggtataatccatctcacagtgactccccaatcatctcactctcatgacccatgcatggagtgggatgctgttagtgcccttttcacggggagaggaagcaggccccatagccacctagaggggatttgattaagcgatgtgatggtaaatgcctgacaaccaactcttgaggaaaaaaaaaagcaaaaaactttgatttgtagtgttagccgatttccctggtgtaaattctcccactgtggttgatttcaactttccgacactatgtccctgaatggagagctcaaaagttgtacaataagtagcaccccataatagcctaatttcaccagaaatgcaataggcatatataacttcaaaagcacaaataagagtaaaatgtattaaaataattaggaagcaatcagttttgagtaattgttatttaatcgtaagtttaatttcatttttaataaatgttgtgtttaacaaccttctcatcaaaattcttaggaatttaacaatccactcttgggagctggtatgaggagagttcagtgcaccactggtgagatctgagtggctatctgacccaaatggggtcaatcagggtctcccctagagacagggagttaaaccttcaagaaccagttttccacattgctggagtatgaagttgggaactgtggacagacactctccatctcccatgaggacagggtagtaggaaaagagtctactgagagaataatgatctgcaaagagaagcagcaataagagaccaagaaaaaattctgcctgtggtgcccatcacctttcaattcctgactccagctatttcagagggttggcccttgggttctatgtgccccctatcttttttttttttttttcttagaaggagtctccctctgttagccaggctggagtgcaatggtgtgatctcggctcactgcaacctccacctcctgggctcaagcgattctcctgtctcagcctcctgagcagctgggactacaggcgctccccactatgcccggctaattttttttacttttagtagagacggggtttcaccatgttagccaggatggtctctatctcctgacctcaggatccgcccgcctcagcctcccaaagtgctgggattacaggtgtgagccaccgctctcggccaagccccccatctttaatacaaattttctatcactgtgtaagctggagatggttttagatacttgcaaacaagtgttctcagcatatattatgcttagttgattggggttggctggagttacaccagtgcagtcaggcacaccgattacttgatgcttctctacaggtatagctatctttaaatagaaaagtgaattactacataataagtgcatttatgtaagtctaaaacattttcaaaatataaagtttatatcagaaaaaatataattttaaaaaacattcaaaatatgaagttcacaccaggaaaaaataataaaacaggttcttggtagtgaaaattttgggagctacagcctcagtttacattggccagtgttacccaaaaagtcatcattcgctaactttagacacatcactttcattattcttgctgcaacagtgtgccaccaaagtcaatgcactgcagaaaagaaatgcaattccttccatctgcataaagtataacctcatttaattgtaacctaagtcaaagtatctataaaatcatggatttaatatgttaatcatattttcatacactttcgattaaataagctatttttaagcaatgttgctgtgtgtgccacctaaaatgatacccaggacacacccaggaaaacatcacatcagttaggcttgattctctacagctgttcctggcacatgaggttttctccgtctcactcctgcgtagcccacgagagtccggatttgtcagaggactatgtttccaggctccgggacaggaggaactaatctgctgttattaaaatgagagcaatacatggtaggcacacatttaactaagggatctgtgttttattatttgggaagatgtatttgcataggttaattcaatgacattctttattaaaaaaaaagaaagaaagaaactcacacagtgagcagcggccaatcctacctttcaacttcatgttaatttgccttagggtttatctgagctgagcatccaagagataccagcaataagttatctatttcatcacatgctgggcgaataagagacctgtctcagttatgaccaattgaatttattctctcaacacagagtatccaagccctaagtagacatgatgctttgggctgatgcttatctttaaaacttcagcagctgatggctcagagttcagcatcaccaataccactttcagccctaagaggagaaagctcaggaatgttttcttgtgttctgattccggctctaaatctaaagtcacttctttcttcttctttttttttttttttttttttttttttagtctcactctgttgcccaggctggagtgcagtggcgcgatcttgactcattgcaccctctgcctcctgggttcaagtgattcgcctgtctcagcctcccaagtagctgggactacaggcacgtgctgccacgcccggctaattgtttgtatttctagtagagatggggtttcgccatgttggccaggatggtcttgatcttctgacctcgtgattcacccgcctcggcctcccaaagtgctgggattacagatcacttcttaatgacttaaacaagtagcctgtaagatcagcaaatatagaggctacaattgtgcttaatgggaaggcgaagcctgaggatccaaagatgagtcagtagtccaagtccctctccacacctgaagcagttcattcttcaggagtcccatgaaaagatgctggtgccacaagtcagaatgcttttatacctaaccaggaagatatgacatgtggtgaagggacaaaagctgaccatttagggtcgtggcttttttgaaatcctatggactatcaagccacaaagtagtatcttggaattcgacttatcgatacaatcttgaaaaggccattactaaaagtaactcttacccttgccttcattcttcatatatggggctcactgctttaaatgttttctagagtcatgctgactggtcatttttgcattctgatttctttttttctgagtaaactgtgcaaataaacagatggaatgtccaagtgatcatataagaacattctgagcaatgaatatgagcagcaagtcatcacgcagcacctcatcacggcagcacatgtacatatcacgtcaatgactgttatatcattgtgtgtgtgttttttaacactagtcagcctaaaataaaaaaatggaaaagacttcatgtcaccagtttttcatcttaggccctcttctgtttcctctgctacacagagtttggaaaaaaatttcaccaaaggctattgaaataaaatataattaaaagttcatgaaaaataaaaaaaagtcaccctctacttgagtaatcaacctcaatttcagctctgaaggtatcatcattaattgcgtgaagtacatcattaattgcattttagaaaaaaaagcttcaatatttatttctaaaatgacatctccctgaaaaagtcatgtaagttttctttccttgccaaggaaataatcttatctcctaccaaagcaaggatgagaggagacatttggacaaaagatctgggaaagtaacacacaaatgtccccatctcccatgcaaatggcctcgtttcttgcgcagcccctaattcctcacgtctgccacatgcccattggttaatacagcggagacatgagagtttagaaatcccaccttcgcaagcttgacacctcatatggaagccgtcagaaaaagtgaacagatagatctgcgctccttagtcatcgggcaaacgacaataacaatgcagcaccattttctgccatcttttcaataaacatgtcttggataggtcagtgcaaacgatacagactgtacagtgactacctcagtggactaacctaaaagcattagtcaaatccaaagtctctgagataccttattggcagaaacaatacctgtaacacatgaggcaggaggtacgtgcgatgtgtcccctaagcaggtatgatccagagagggaagattgtatgtagggggaaatgacagcattgaattttaaattcccactaaaaacagaaactaatagcctatgttatcaaacagctttctttttttctttctttcttttttttttgcctttgaaaactaggagaattgaacaagggtatctatgggcttccaagtatttcttctgtgactgtgtggcctggtggacacgtgcatagtacacctatccctgcattcaagccatgagtttgggaatgtccagaattcgattccacattgttatcaggtgaaactgattttacgcgcccacccgcctctcctgcaagcccccaaccccctgaacatttctaaacttccttgttgctatggctgcttcttctctttttttaaatttttttcccttcctcttcttctttttttttttttttttttttttttttttataaggcctctggccttataccgctgtttattacctcaggcaaactctctctctcactccttttccctctctgtttctttaaatctgtaaaccacaaagcagcatgccagcaacaccgtgggtcaagatatcaaaagagggaacttttataggtttcctcgataacatggacaataaaagaagaagggcgcacaagcagcattactgaccttatttgatgctgttcagtaaagagagacggctcttccaccgcctgcccgtgtaggtccgggccatcggtgtgtgaagagggaagctctgtatcaacacctggtctgggttttcttacactcctatgccaaagccctccaaatgttttcggcaaataatacccaaataaatggaaggttactgaatacatgaaactcactgcagcaagaaattgcttttcgacgcccagtatatacagacaaactgtttttctccccacactcacacatatgaatatcggtaggaatttagactctgctaaggacatgtgtgctatgaaagcagaggtctgtcttccaaatatgatcgctgttaatcagcagtacttacgctgccataagctatatattttggtgattagtattagaaggagaatgttggagctcattgtcataatgtttcatgaagacacatcatgttgaaacaaaatgcatgtttctttggcctgacgtgcctgctggttttcatgtgatatgggtccaagaggaaaacgtctttagcaggccttaggaataactgcttccacaaccatatgggctaggcgaagtcctagatgagtagaaatgaaacagaacactcctgctttcacgtgaaactctttttttgttttccaaatagttaaagtcactttaatcatctattttcaaggaagatatattttctctcacagtaagaaactgcaaaggaaataaccccttttttcttcaggtccccaaagatcccagctcctaacttttagtcgcatcaaaatctcctaagagaatctagtctatgcctccattgtccagccttaacagagaaaaaagatcaatcatttgagtagaagtaaaagcaggaagaggatcaagagttattttctcctatgctgaaaattccattccctggctcctaagaagttgcatacacagtttcctttgactttttcaagtattttttaaccacttgctctttaaataataccagtctgaaaatcatctcattgtccaccaccttcactgttttctagatgagatactgtgctcggtgaacatactcctcaatggcaaccaagactgtgaacaccatatttgccaattccagagtcactctcacgcaaagccatcaacctgctcactgtcagaggcctctgaggacatcagtgagggctgggctgagcctaggcccacagagagatgcaggcacgtactgcttgggctatgcttcctaaatgtagggattttggacccaggaaaatgagatgctcttttagaatagatggtaggggtcatctcagagacccagtttccccagctgtttccagaaacagcagccctggccctgcctacccagcaggagttaccccaaagcaccaggccagcctgacccagagcctcattctccacccgtccatctgcagcctggagcatgtctccacctttatgaatatttattttgggcccagcaaattcatgtgagatttgatgtgtccttcccactctcctctccacagaccccacgaagtattaaacacatgctatcatcccagcactttgggaggccaaggcgggaggatcacttaaggccaggaatttgagaccagcctgagcaacatagcgagacctcatctctacgacaaatttaaaaacttagccaggcctgtgggtgcacacctgtggtcccagctactcaagaggctaaggtggcaggatcgcttgagctcaggaggtcgaggctacagtgagctgtgatcacagcactacactccagcctgggggacacagcaagactggtctcaaaaaaataaaaataaaaataaaaataaaacagaaaaagccatactatcaaacacacaaaactaggaatccaattctatttatttggcagatgacctagaggctccaaaaatgccaagagcaagtgcttggtccctgcatgcagagacggatgcctggtcctgccatcaccccttttccttacatgggacgcttggatgagagagaggcggctcgcgaggcaaatacgggagtgcagtcgccattcctccttctgtcttccctcccagccctgtcctcctgccctcctgtttggtggttctcttttttttttttttttttttttttttttttccctgagatggagtctcactctgtcacccaggctggagtgcagtggcacatctaggttcaccgcaacctctgcctcctgggttaaagcaattcttctgcctcagcctcctgagtagctaggactataggcacctgccaccgtgcctggctaatttttgtatttttagtagagacggggtttcaccatgttggccaggatggtctcgatctcttgacctcgtgatctgcccacctcggcctcccaaaatgcttggattacaggctcgagcaaccgcgcccggccctgtttggtggttcttttagcttaatgtggtgacaacacagctcccttagtgatgtcaaatcccttgcacgaatgcagaaagcgtttttctcccacacactttcaagtggccttaatggagcctgtgggaaggctgactgctcacagtggaaccagaacatttgggtgggcctggggcgggggctgcacagggtgggactgggctgagatgtttgaatgacagtatggtgatgtcagtgcgacctgagcatttctaaacatgcagaattttttttttcccaacgtccttatttttatacaactgagctaaatggacagacacctgtccattgtgaccacttgaattggtggagtttatacgtccaggtggaatgagatgactcttaacaggagtattggtctacagggtaacctctcatttttcagtgtcacaaactagactctaaaatactgaataaatctgttcatgataaggcgtttttgtaagtgacttgatatcattatcttcatttgatatagcaggaaatatctggatttaaaaggaatctgcatggggttgccagacttagctagttaaaacaaaaagatgcccagttaaatgtgaattttagataaacaatgcacaatttttttaggtataaatatgtctcatgcaatagttgaggcatactcatactaaaaaaaaatatcatgtatctgaaattcaaatttaattggcatgttgtattttatttgggaaccctaaaccttcagagcgtgtgtgtgtgtgtgttgggaaggggttagagcaatggaacttcactctgttgtgtaaattttgggggaaatgtattcctaacccctggctccttgcttggatagaaatatggccactgaagagaagatcagatgagctttgtagtttttaaccgtatatttccaggtgcctggggaccacgggaaggagaagggttgcacaggcgatcctgaatcaccacgtgaggaggaggctcggctcgggcaggtatgtttttcaacacggctctaacagagcgcacacaggtgattaacattcctctgctgaggtttatgacttcattagaatatttctcatcataactgaataggtaaaaaatacctggctattaaatacaagtctatccctcaggatgaccagattatcacttgaatttaaaatctttctgaatttttaatagtgcataacaaatacgattatttatgcactttcttccagtactcaacttgccaggcctacaattatatggaacgccttcagtttcaatgggagggattaattggagctgtgcatctcggcctggtcccccctttccttgtgacctggaggaagcctgtccggaatcctttggaggcaccggcagggcctggctctgtgttatttagaaacccctggtaattagcagcggggagatgtaagagccgtggtgtaaagggagcagctgggaatccataaagctggctgatgagaaagtcaagtggaggcctgcctggctgaaacatcttcaatagatctgtagtctgggcttgaaccctgccctctcacctcagggtccgatatttctttcttttccatttttttcctctgcccaagtcccccgcccccaccttctcttctcctcccagcttctctatcaaggaatgatgtactcagactgtgaataaatgcgagtgacccccatctgcccacccccacttcccagagccttctgctggagaagggggtgggggagggaggacagagagagagggagagagagagcgagagagggagagagagagagagagagagagagacagagggagagaggcagagggagaaaggtacaagagagagaagggaagagagagagggagatagagcgaaaaaggagggtccccgacttcctcacaggtaattaaaaggactgttttcaaggttgcatgggcaaagacaattcggccctaatgaagcatcgatcgactgcagtaatgtagaaaggagctgacattcattcaaaggtacctttaactgtaagacactgcaccgggaattattcgttctctgctgtcattgcctaggacctgggttagggagaggaaaaaaaaaggtggggtggaggggagagtttgttttacatttatttccgcatcgccacaaatgcatgtgtcggggcttctcttttccttctcttctttttaaaaatagaatgcatcagagcacagtctctttggatgtaaggaggggggccctccccgcttagggtaaattttcttcattagtcacgtttaaaagcccaccaatcaggcctgccgggtccggaattcaggaggtcagcgacagccaagcaggaactctttgggaagggtaggggcattgctggctggctgtaaacccaaactcgtttccctccacgggtttggccgctgtctgctttgtgctggtgtttgctattctggggcaaaccccagaaacctcgagggaaagagagcttggggaacggggacctatcactgtgcaaggggatgttgacgatccagccaaggggatggggatctggccataaagagaccaaagatgcttgtgggaaggagggtttcggcaatccagggagtgagacggggttttcgggttgcagaagaatgccaggtaaaggtgtgggagagaagcgaggctgggagtcacctcccagtccacctgggggacacttcttctgggttccccggccgtggacatgacttcttgttttcctcattagccctaaaaacatttgcctttggagaggatccaaatgagaataaaaagatactaaagtgctagtcgtgccaagtcaatgggggaggacgatgacggaaggagagtcagtatccattccaaaacaagtggagtgttatctggaaaggttttgcccacagccccagctccactggatcttacacgaggcccctcatacaacaatagcaggtcccttcagagcacgaaacacaaagggaatttgctctggttcagtctccacagtgaggcccctcggaagctaaagagagtcacttccccccgacccccacctctgctaaaaataagcgtgggaggcaatctcagacccccataatgacatccagggtaccataaacctatcctgttggcaggacatttcaaatcacgggctctttctcccattttctttctctctttccttttcttctcagaatttatcgtcgtttcttgattttgcctttaattttggtttggttttagagggagggggtggcagggtatattatttaacttgataaacagcattagcacagcgctgggccgcctcctggcttcggcgtctctctcctattttttcatttgtgtttacatttctaagacatccccttagctgaaggaggatgcttcccacatattgcactataggccattcatgcaaaaggataatttattggccgcacagcctctgaagttgaatttttaaaaagaaaaatcggagcccagtttccccaggtttgctgcattcacttgtctttagtttgtgctcttcttcttgcctttatctttgaaacagtttataacattctatttatcaatttgatgctgtttcctcctggttgttatttatttacttatttattttgtgctgccaaagaacaggtcaggaaacagaggcagaaattgggtggaacacctgctgaaattaaaaaaaaaaaaaaaagttttcccctaaaaaatgactaaactgcagcccagcagatcctatctgcattaatttggctgaacaacaagatattgcaggggacaaactctgaataaagcagttccgagttcccagaattggcacagctcagcctaaacaatgacggcttcctattcaccttaacccagcttttcaaaagaacatccccagaaacacaaagcatcagcgggaaatggcaattttatgaatcctaatcaatcaaagggcttattaactcaatgtgaagccagattaaaatctttaattataaatcgtgctaaaaggaaaaacaaaatgtacttatggtacattgaaaattccggatattaacatagttgctattatctcttgcaatattaaattccccctccctttcccccactacaacctcacctttttctattactaaagaacagggctacagaacccaaatcatttttcccctcgatttattaaaatgtattctttttctccccctgtgcatccaataggtttctgggaagctgcgttggaggctgtaggaccgggtatgagaaatcccattactgagccccgggcagctagggtttcagtgtgatgctggaggtagtttgggtagctgtttattaagaggacagagttggtattacagggtcggtagttgttttgttttgttttctttttggcggggggcgggggcgggtaggaagaggacagcaatcagatggggagcatttttgctaatgaaagcggcatgcgtgtctgtgctcgtaggtttgattggcaggagtggagattgccagccccaggaagggtcctcgctttaagccatggtgtgagaaaaagctttgggtgctgctgttgctgctgctgctgctgctgctgctgctgctgctgctgctgctgctgctgctgctgctgctgctgttgcttctttttcggcttcttcttctccttttttaatcaggcagacatttgggaaatgaccacagcaaatttaatcacagttggggggtgaggggggagggaggcagagcagagactgtgattcacatgttttatttatttgttcagagtcacggccatcctattgtgtgtccctcattctgtcatttcaggcccctccgacccacccctacccctgtccccattgttaatgtaagaggcagagaatataaccacattttgtaataataacatatccaacgttgcaaaagcaggcacctcatcttgagaggggtccttttcttacattgaaatgatagaaaaacaaaaagaaaagaaaaagaaatctctccatcctaatgacaatgtaggatggagagatttattctttgtgtaaaaatgcaatgatgttcctagctagggtacatgccccatttcctcccctcctgcacatcggctatggtactattctatttttatatttacagagcaaaccccatgttaccaaattggctttaaattaaatataaagggagcgaaggaaaggaagaaagaaagaaagaaaaaaacctgtactatcaaagctaataaaaagaaagtaataccctggtttaaattaaatcctacttcattccttttgttcaaagttcagaatttctttatctcagcctctctcctgaaacattccttttctttgacttttcctttagttccagggacaggaagccctcgtccccaaatgaggtctctaaagatccttgccactttccttgctaatcctagaactaggtttcaaccatggatgggggggtttgtcaagaggggagagacagctttcactggcaaaaatcttgatggtgagtagggcttgattttcataatacaaggtcgactctgtgctctttctatctgaacactaggtctaaaatgccttatttaaacctgactcaagagagggacatgtccctgatggacacaaacccagtctgccccagtgacacatcctggctccctcccagctgtgcgccttcctcaaacattcaggatccttccaaaccatattcttgtagctactgctatttcaaaagtgcagggaaaatatggttttcctgattactttggaacttgtgaacacagacgcaatgctcaatgttactttaaacacatttactaacatctttatatgcttgaagcaaataaagatttacccaaatgctgctttagcatctgaaaacttgcagaaccccattttggttgctctgtaaccacacttacacagtccttgctataaacacacgagtctggtttttcttctgcaaatatgtatgatttctgtttagctccatccctccttgatttttctgcctttgcagactgataattttgtagttatctaaatggacaaatatagccagaggaaaagatcctaaatcagttttcatggctaaagtgcacacggaatccattttggcaaaaagcactcaaattctcagaattcctctaaatccttaaatgccacacggctgtgatattcctttgaagacgagcattggacctaataaaccgaacactggaggcacagatctcgtcttctttagttcttgcaacagcttttcactaaattcaaaaaagaccttttgtgcttaactgggttttcatttcattgcttttaaatttgttaagcttgacttttgacactttgggtgtttagccttttttttttttaaaaaaaagtgcaattatataataaatatttgtgcttccagaaaggaagacattcatctgttattaatgctcgtatacaaagaataaaatgtacttcactcttttgttagaaataacccacataaatatgtacatttttttaaaaatcatctttaaacaatggcataaactatttttgaaataacacacagaaacatggtatatacaacgtattcactccactagaaggtgtaaacaaaatataaaaaaaattaataaagccaagaaggaaagataacttgtataaataattatgtaaataaaatgtgcctttgaattgctatgtaaacaaattagacatcaaatgataaaaagcacagttagtaaattacgattctctataaaaaatatgaaactatttgacttttcccattgatttactttcccagttcacttcagcaaatgaaaaaatatgagtggagacggctctcagcagctaaaatatgaaaacaggcatttgtttttgtttttcttttaaaaaaatgtatatgcaattttagttacttctcagaaattacaaaagggacatttaggaattgttcacaaggtgatgctttgagattaaattttcttttgatacgcttttaaaaatattcagatacacagttttgaaaatattcacctcttaggtgaggatcgtctcaatctaatagaaatgttttttttccttttctgcctaaaggaaaatgattttaaaattattttctgaagaaatattgcatggaaatcaatatgaaaaacagcattattagtaagtggaacataattcttaaacattttagtccacttattttcaggtatttcaaatatatttaaaatatttttcatatatatttttatccacatcacaattcttgttgggtgttaatacaggttctttttttctttaatgtcaggaagaaaacggcagtcatgataggaagacaatatttacgtttttctatcttctttagtttagttccaaatccaaataaataggaatgtaaaaatggtttaaatggttattttagaactctgcagggaatcttctctttaaaactatttcaagccttttctaaagatttctcacatcagtattatgttgttggtttccttttgaaaaacactctgcttcttaaagaaccttataatttaaatgtatttcctatgcatatggttttgtcaaaatcccagtccaaacacagaaaatgccccgggtctccttaacacctccaaagctaatgtttataggccagcttaaatctgagcagaaaatattcaccacaactcctggcttttttttcttctttttcttcttctttctttctttttctggatcggacgagcgctacatttgatatagagactgattttttttttttcccatcaaaattacatgagaagcaaaaagctggaatctaaggctctagacaaactgggtgggtctcctcactcctgtcttttctcagtgtcagactctatgtttagataaaacaatttatctttatcattttcaagctgttcagacgggcgaggggtgggaggtgcgaagggtggaggggtgagggaaaaggtgattgtttcacttgttgtcagagggcattgatcagccctgctgtctgctggtctccgaggtgaggccaggtcccccaggagtacttcggggctgggccgtgtcagggcaaagctgtattgagtcatgacccagatgacggctcattgaggcaaacgggtattggcgtccaaatcattctgagacaccctcagtaacacttaaaccagtccactccgttaatgtcaggtcacgggggacacatttagccccctctgctgaccattagaccctttgatggagtggacgataaacttgacgggacaagctggaccctgcacttgagtctgcctatgtttacagtaggcccagtgtgaggctggcctttggagaacgcccgccgtccctgtggccaggtcctctagggactctggcccttttacaccacacaggataaaacagaactaaaactagttttaatgttccagcgtcaaagggagaaaaacaagccaccgtgatccttcgcaaagtttttcaacaatgaggtcagatacaaattgtggatgaagtggtctggctctaccattttgtaatttttatttcttgctttgatttttctctttcttctaagcaccgcttatatagtgcaggtattttgaaatccatttgttataccttctgtggcaaagaacaaaaagaattccttattgtttcccagggaagtagagaagaattcaacaaaaattcactctgttgtgatcataaggtttccagggcagtcttctgaaagggaattattttattttgtattaccaaacatcaaatatattttggggagagaggggaataggaatctaaagctaattgcatttcccattgatgggagcattagcctaaaacaaacttgagcttggaaatgaatctaaagtacaaactaacaaaaaccaagtctttgttaacattcaaagggtgaattaataatcattattgctactatttaaacaaattatacctaaatcttctgttacacgagagattgctactgtttacttttgctgctttcccaccagcaaaacggcctctggtttgacagagcagattttctggtattaaaacgcttttatcctagttttaacaccttgtctgaattcctcttgagaattaactgatattgcatgagaagggaaaatgcgagggggttttcaagtggcccccacactcaaaaactcagttcaacagaaacaaccctcccttcttcaaacaataccagttactaagtacacaagtagcatgaagaaaaaaaaagtacaaatgagctaactaatatgaccaaattatgcatctgttttgtcttaaaagtaaatatctaattaaaaagataatctagttaccaaactattaactgtccttctgataaataaggaagcagctgtgggttatgtttaaccaagggtgagggaggtgtagtcactctcaggttctcattgactactttgcattatccaaacctgagagacttttccagagttcatattctttgtttcctaatgcagtctggaacctctagagctggctaaaattcagaagtgtttctcttaaaaggagtcagtttatcaagccataaagattacatctcattttcatatcaatgtacatagcttcattccagagaaactggataaattagaacatgtacccacagcccacttgattacatcctgtccctgaagcttgaaagtaagacttatagattcagagacttcaaatgatttcagggagtttatattttggtatggttttggaagaggtgttagagtaacttgttttctttccatgtgctattaatattgtgtgtataatgcatacatataaacaagtatcatcaacatttactaactccatcttgatgttttatgttgaaaggatagagataattctagcatagatgtgtctgtgagtgaatgagtgagtgtgtgtgtgtgagagagagagagacagagagagagagaaagagagagaaagcacacagtcatgtatcttttactcatctcatccaaatagacttctaactacagccctaactcaagaaataaattgcattgatctggtatttaaaatggggcaatcttgagtttttagtgggacgagataccagagggaaattacatcattgccagtaaacttctctctccaccctgctttcggtaatttttcccacctcttcctttcaatttgcaaagtcaagcaagagcctaatggagagaaatacatacctattatgccctgtacatgtttttggcacctaaaaagtataccattagtaattggaaaaattagccataaaatccatattgactaacatcgtgccatttcattcaaaaatgatcattctatcctgatccaaatgggcagaagctcaaaaggtgtaagacatagaatccatgaaattaataaaatcaccttgattttaaaacagttagaaactgcacttccacatttacactctcattttctcaccaccactagcattccaaataaaaaatcagtagacttgggatgggttctatacaaccacaaaatcttagatatttttctgaggactagaagactgaattttctctgaactctgttctcagaggacatgagtgtaaatgagggaagaaaggcattttgttcagtagcaaaagaacattaggtacctgtttgtcatgctgcatttatattgctttttatgtattaaaaaaaccttagattttcctgctctagactgatacgtctgcctgtaaaattcttggaaaataacataccagttaacacgcaaccagtaacacctctgaaggcagctaattctgaatttaactcttcttgtgacctaagtttccttctcgggattttcattcacatccacagtctgagtattccaaggaaactttatccttcaagcaccttttgtcacattctgccgggctctgctaactgtcctaatcacatcgcctgtgaattggatccaaggggagacaagcactatgtatgccatttgctcattggctccatgagaaaaatcaaacatggacattttactccaataaaccaatgtttcccaatgttttaaattgctacctggaaaagaagtcgtgtaactcctttttttttttttcaaaatagtgtctgatgaaagagatcccttatattttttgtttagttttggatttcaccttaatctcaacacattttgaaatggctcattgaacttcattctctgagctctagctctctagaggtcacaagaaggtcactaggatattctctgaaagcatcacatgagataaaaatatacagattccacagtttcaacactgtcatcagggactctagcccccacgacaccaatgtgtgacagaaaacgatctcccttctccatctaaaaggtgagcagagtccagaccagggctctggtctgtcctttgaaataatccttggtccctgtggtgaatatgatgaaacattggtatctcagagccattttccaatatagtccaaaccactggtcacctccaatgtcactggtcacaacctctttatatttaaggacagcatagactggtcatgttaatctgttaatgatgtcttaatggcaacccaaaattcaaagccgacttgaggacacgatggggatcccacctggctagatagcaccatagactccaggtctgcctccaagtgtagggtggggaagaagggtcttttcctgcttctaggtgccaggcctagggtttctcccacctagggggtctaaggaagaaatggattttctctttctgttcattgtatttcatcatctgatcactgaaatgcttaatgtgagttttcagaaaaagtagggcagatgatcagaaaaagtgataaatggcggctgcatttcacacggttgtttataacaaactagtctgaactgctgcaccaggagtcacagtacaaggggggaaatgtatgcaggcaacagggagttaagtaaataaattttttcttttcttcgtcaatgtgtttagttctcttcctgccaagattcatctcactctgctatcttgtgagagacacatatggtgcggtgaaattgccatccaagaaagcatgtcccagcctgttgagacatcatcaaataagattaaagcaaagtaaaaataaaaagatagaacgatttttttttcttttccttgtacagagaacatctgatgaaagccactgaggtacttgaattgcttctaaaggtttgcagccatttctttactctggatggttaagaaaaagccaggaataacatgacaatatcttctttgcattctccaagttagtgaaaaaaaagtgcttcataataaaccagacgtatatgaataaaataccatcttgccttcagcacttcagttgcaaatagcacttaaacgcgctgtagacagacctcagtcttcactttcccgccttctctttgctttctacagattcagacttttcagggtggcatagaataaaactttcatttttaaatattagttattaagattccttttatggcaaactgtggctaatttctggctttcacagacctcggaatgggaaggactgagtttcatcttcagcccgttggtggtcatattttcctgcggtggctgacacactcaggaggcgtgggatagaaggtgacagcttctgctactcggtgtccctgcagttgccagcctcccagggactctgctcacctaggaaggtacagcttcccttattctcgccacctgattccattaggcccaatgtctactaggccgggatattataaatagacctgaccttcctcagtgtctctgtacctggaaataccctgctggtacgggtatgagttagctagacgactatcacggccaactccagaaggcagcatctttcccacccaatgccccctaagtgaagacttacagtcatatccaatttctttccctattcccttttatctttaagaatctgctagctttgggagaatttatgaagggagcgggaggtgggggaatccacatgccactctcttaagactcttctagaacattgaaggcagttcgtattttattttttttgaggaggagtctcgctctgtcaaccaggctgcagtgcagtggcgcgatctcagctcactgcaacctgtgcctcccgggttcaagcgattctcctgcctcagcctgccgaatagctgggactacaggcacccgccaccacacccggctaattttttgtatttttagcagagacggggtttcacagtgtcagccaggatggtcccgatatcttgacctcgtgatccgcctgcctcggcctcccaaagtgctgggattacaggcgtgagccaccgcgcccggccgccatgtttgtatttttaagaggctctctgcccctccgcttccctccccagtgggatttcaggaagtactgtaaactctttgaaaggatgcagttggccgggtgccggggctcacgcctgtaatcccagcactttggtaggccaagatgggtggattgcttgaggccaggagttcaaaaccagcctggccaatatggtgaaaccccatctctactaaaaatataaaaaattagccgggcgtggtggcgggcacctgtaatcccagctactgagcaggctgaggcaggagaatcactggaactcaggaggcggaggttgcagtgatctgaaatagcgccactgtactccagcctaggcaacaagagcaaaactccatctcaaaaaaaaaaaaagaaaagaaaaggatgcagttacgaggtaaacaataccatgcttcatatgggagggggcccaaagccaggctttgaaattaaattacattttgtttaagtgtctagagagggagggtggcaggcagtgaaagacaagcatgtccctttcttaaatgcagacacagtgttttctgtgatgtgaagtcagtttgtgtttctaagcagagatgaggaagcagccggagcatttgtttgcaaaccgttctaggtaaggtttacaagatcttgtttccgatgtgcggccttaattggacctctggaaagcaacaatgcatcagtggaagagattatcactggccttaataagctgttgttggctttcataacagccactgcctaaaatgaggcacaccgagcccagagacaatcttaccaattgcctggagcaaggattaaagcaacaaggatccgaaggagagaacgaaaggagtggggaggggggtggcggaagaaacaggggctaatgtaaaatcgtttccatattaaccttcttcccttctgacaatggtcaagttctgattcaaaatacaaattatctccaattacttcaaaagaggcagtcagagagctgtcatttaaccttcaccatctgtttgcttcaaaagaaagcggtacagcctgccacattgacctcaactttccctcagagctctggacggcaccaaagatggaagcttattgtcctctgaagaaaaatctactggggttttcagggtggcagggaagcatggggagggttaggaaagaggataaaaaggatagatgttacagggggaccaaaggaaggagtcctagggggtgacctagctcaagctgaggtgatgtctagagtggagtggggggcttacccatcctggtcttctttactcaacatcctccactagaggatgtggtttaaaataagattggctttaagaaggcctcagtgaggccgggcgcggtggctcatgcctgtaatcccagcactttgggaggccgagacaggcagatcacgaggtcaagggatcgagaccatcctggctcacatggtgaaaccccatctctactaaaaatacaaaaaattagctgggcatggtggtgggcgcctgtagtcccagctactcaggaggctgaggcaggagaatggcatcaacctgggaggcggagcttgcagtgagccgagatcaggccactgcactccaccctgggggacagagcaagactccgtctcaaaaaaaaaaaaaaaaaaaaaaaaaaggcctcagtgagctgagacagctgaggaccccaggacaggcaggatgaatgaggcccatggtgtggccgggccttttgcctggtcttctgtcatgggaggccaacaaaggttgcctggtacaatcaaagaagcaagattgaaaggccaaggagagtagcgctttgggaaaataaacaatctgttagtactgtactattagacccttgtgttacaggaaactagtccggacccagacctcaagagaggattcttggatctcacacaagaaagaattcagggcgagttcgtaaagtgaaagcaaatttattaagaaagtaaaggaatgaaagaatggctgctccgtagacagagcagcctgagggctgctggttgcccatttttatggttatttcttgaagatatgctaaacaaggggtggattattcatgcctcccctttttagaccatatagggtaacttcctgacattgtcatggcatttgtaaactgtcatggtgctgttgggagtgtagcagtgaggacgaccagaggtcactcttgtcgtcatcttgttttagtgggttttggccggcttctttactgcgaactgttttatcagcaaggtctttaagacctgtattttgtgccgacctcctatctcatcctgtgacttagaatgtcttcactgtctgggaatgcagtccagtaggtctcagcctcattttatccagcccctattcaagatggagttgctctggttcacacacctgtgacacttggatgggctaaaaaatgaaatctacctgctcaaccaaaacccccaaaagcacaccattctggagcctctctgtggaagcacgacatctcagtctgcatcaaagcaattatacctcagaaaaccaaattccatcatctacaggggtcccgaatgggccttccctccttcggaaatctagcagagttaaaggaagagagaacagcagtttatgaagatgtcccaggacaagactgaaagcaccagtagggagaatggcttcccaacaggccacagtgaaataatagagtgcaaatttctaaatgcctgcattttatgggagatttctaatgtgtgtgcccacgtacattatattatttccactacctctgatctttattttccattttacagcccactgaataacaggttttttcaagagagaaagaaagaaaacagatcccctataaatgaggacaactttgactcgtaaacagttcatgcgctcagagaggaaaggcacctggtactttctaaaggaaagcacctccaaataccagcaccatgtggtgggagggcaatgctttgccttatcaaatggtactgaagcttgaggtctgtttctaccaccacgcctggagtaactgtcagggcctcttatttctcatagccaaagcagatgggggacaagtcgattaaacacagaaagctgcagtgctgttattaagcagtatcagcacggcaatgacggctggagggaccacggtgaagggcgaaacctaaacctccaaggatgggctctgcattcacctaaagcccctccccccacacgcacatacacagaagaaaatgactctttttttttttttttttttttttgagacagtctcactctgttgtgcaggctagagttcagtggcaccatgtcggctcactacaacctctgccacctgggttcaggtgattctcctgcctcagcctcctgagtagctgggattacaggcacctgccaccatgcccagctcacttttttttatttttagtagagacagggtttcaccatggtggccaggctggttttgaactcctgacctcaagtgatctgcccgcctcagcctcccaaagtgctaggattacaggcatgagccacctcctcctctcccttctctgctccttaagcactcctctttttgtgtgtgtgtgtgtgtgtgtagagacagagcctcactctgtcacctagctggagtgcagtggtgctatcacggctcactgcagctttgaactccggggctcaagctatcctcccacctcagcctcccaagtagctaagactacagacacataccaccatgcccagctgattttttttatttttgtagaggcagggcctcactatgtttcccaggctggtctcaaactcctggcttcaagtgatcttcctgcctcggcctcccaaagttttgggattacgatcatgagccaccacaccccgtctcccagcaatttccaagtacaagtcaagggttccattggcagctcactgaaagacactgcgtttaggtgatggcattagctgtgcaacactgggctttgatgaaagcaccctctttcagatcttctctcaggcctgttcatcccttccaagttcagcttagaagatactgggccacctaatgagttgtcagaagagcgaacaatggaaatgaaggtgcacatccctctctcgggtccggttgctgcatctgatataagccactgtctctgatgggtatctgccctttcacacacgcttccttgctggccagtgcaaatgttctatatttgagtcaaacatagaagacgacacggcagaacttcttggaataaagaggtctttggcggactctggctctaccctgtctctctctctctgccaccgtcccctccctggtaagggaggtagggacagtgggaaaatcattaagcagcagcatctggacctgattaattaactagctggagcatctgcaaacgtgtcaggcctgagcctaggacaaagtcctgtgagcaggtttgtgttcaggaagggaaccggctgttacattttataagacaaatattatctgttcttcttccaggatgcttgttattaaaagctggatttaatagaagaattaaaagggcttgtttcacttgacatttcatccactaaagacctgaggggggaaaaaaaaccccagtgcctgatgatcgggagcttgtctgtcaagttccttctctgttttgctttcattgttttccattgactggtttttgcaccaaatgttaaagtcataagatgctgaagatttcccagttacaggaatcttttcaaggactatttcagagaccgcaatgtgcaagagatgctcattgctaagtaaatatcacactaaaaatccagatcttcctccttccgccgctgacatacaggtagtggaggaagcaaaaaaggacccattctcaggcccatttgtgttcggactggctaccggctcccttcagaagtcgacgccattttatcctaaagacactgtcagggctgacttttaaatgctcttttgatgtcaagattcacacggatttgatgatcgttttctacacttagggccctgtcgctcttctcttatattaccccatcaagttggtacttcataaagcctgaatcatcattactatcatcttaattgctaggcgggtttgggtgtaaatccaggtctggaggataaaatccctggggaattcccaggtgcgaagggagtggcccagactggggattcagcagcaggctgtgaactacctgatcaataaatagcacgtggactacacgagtactatctgtgatttaaagataagatctccataatcaggagatgggaaggggatacagctgtgttctggttcagagcctccgaaatctcacttgtgtgagtcgctgctacttaatagcacctcaggtcaaagacaggccgagttaaaacactctgtgagactaggaggtggtattctgttccttatttaaaagacagagaccttggaagatttagccaaataggcaaaaaagtatgagattagtgaaagggaacaaacataatctaaattgatccctaattagggccaccacataacatacaggaagtattatataaagaaataatatgttaaaatattcagtaaaaagatgttctgtatttgggacaagcttctactgaaaagaaattatttgttgattatctgaaatacaaacctaactgggtgttctgcatttttatttgctaaatctgacagtgctgcaccagatttgaaccagtatgattttcagagacaggagactgaaattctagaattttccactgacagtggacattaggcaggtaacgttttaagtttccatccgtgtgcagatgggaactatgcattaaggtcattctgcatgaaatatctgcatttatgaattttttaaaaaaatattgttttaccacttttactgcatatacaattatctaaatctccaaaaatgaaagaaccatttctaagtagaaggccttagaaaagatatgcagataacaagagttaaatacttacatatcaaatttaattagctcaaacccttaaaaacagtttaattacttttgctttaaaatgctccaccatattttgccacagtccaaatttagaaaattagtggaaaggtaacagacacctaaactttctcttaacaagtcaacttatcataaatttggaatttttcaagttcaaaataactagggtttattattcttatactttactgaagacaactaactctctcccagtgatttctttctcttttcccttctgattacaacaaaaatccagctacctaaaataggcttattcctcaaaaggaaacaaaactgccgagttctatgacaataatactaatcaaaagtccattttaattgttccgggccctcatagtgtatttgatctgtctctgtgggcatcaggatgactgggctaagctgtgggggcctcctctccactctggagcagttttgcatttcaactttgaaaaatgaaaaacctgaatgcacctaggttcctaacttgggaagaaagtgctgaaatagattttgtttaaaataaaagagctctaaaaatctacagagtaactcttttgagacaagcgaatacatgttttagcatccaagtgggatatagtcattaacatcctccttcaaagacagtctagtcaatgtatctgctgcagcaaaatatttgggatttgggcaatgcattttggatctgaatattccctaggttctgccaagatagcacctaccctaggaatttctctgtcaaagtcgtcactaaaatgttctagactgaaggttgtgccctgaagttctgaattgcaaagggccacagtggtgtgtccatcttaagaagtggctatgagaggccgggcgcggtggctcacacctgtaatcccagcactttgggaggccaaggcgggcggatcacgaggtcaggagatcgagaccatcctggctaacacggtgaaaccctgtctctactaaaaatacataaaaattagctgggcgtggtagcgtgcgcctgtaatcccagctactccggaggctgaggcgggagaatggcgtgaacctgggaggcggagcttgcagtgacccgagatggcgccactgaactccagcctgggcgacagagccagactccgtctcaaaaaaaaaaaaaaaaaaaagtggctgtgaaaagcctctcttcattcacttgtctcaccagagaaggcagagatgatttctcccttttgaaagatggctttaaaatgacattgagagggtcaaaaaaaaaaagaacagacaaaattatttggaaataaaaaagagtacaggcaaatcaaatgtccccatgtttttaaaagcctttctatgaaactggtcctatttattagtggtgaaatacaaaccatgctatcaagaatcttaaggaaatggattgctgttaagtgatacttcagaatccaccccctagcaaggctactgcgccattacaggaagataagcagaaaatccttgcctcccataagggaaacctttgcttgaaatacgtgtaaaccattcagtggcagttctaaagccagtgattcaaaatattgctctggaaaatttcagttaaccagcagtacccagggtctttacagacgaaaacaaagaccaagactttgtcaagggaggaggtgctaaaggaggtgggcagcctctgaaagtgcagtctttttttgttttttttgttttgttgtgtgtgtgtgtgtgtgtgtgtgtgtgtgtgtgtgtgtgtgtgtgtgtgtgttttgtttttgttttgtttttgtttttttttttgagagggagtctcactctgccacccgggctggagcgcattggtgtgatctcggctcactgcaagctctgcctcctgggttcacaccattctcctgcctccacgccattctcctgcctcagcctccaaagtagctgggactacaggcacgcgccaccatgcccggctaatttttatgtatttttagcagagacggggtttcaccgtgttagccaggatagtcttgatctcctgacctcgtgatccgcccgcctcagcctccctgaaagtgcagtcttaaaggtccaatttttacactcattaatattacatgtaataatctacagtattagggatgtgattggttcctgcctggctctgtgttgcgtgaaacagcaataatctaagtacaacatcacttcctatcctcccaccctccacatcctgcagtcccccatccctgcccttctacctgtcaaaatgcagaaggaaactgattaccacctggaacaggttatgctcctagccttgcgttcttagaacattttgttttggagtcctaggattctttttatcaagagaaaaaaaattttaaagtatagacaatatccttgaggagtttgtaatctaggtgggaaggcaaaacacccaaagaaaaatgatgcaataatagcatcttggatgaagactgctagatcaacttctcaagggactcaaagcatttctttaaaatttcttcataaaaaagaagcaagtgaatgagttaattcaaaaatggcttcaattgaaatccaaagcaggacacacactagggatagaccataggccaagcctaactatggttttgtcgctaggtcagagcaaggactagcgagggtgagggagtgtttgcttcctacctgtcacaagtctccatctagatgtgtagaaaacatttgacctctgggtttggttcagcctctccctatcctgagtttgtgggaaatagacggccacgtatcatggtcaccatcatcctcgctctctgcataaccccaggtgccctgggccaagggtttggtgcctgcaggcttgctgagccacagcttccgccgattccatgctttgaccccacgctggggtttacatcccagttctcatccaaaatgctagcccctgcttcatctccattatccctcggttctatcccttcaagatgggccttgctttctctacgctcaaattatatcaagcatcctaagatgtaagttccagcatcactacatgggattccagttattgccaccattatctcaagactctggctccttgactgcctctcttccacccatcttcctgcatccctaccccagccagagcaaactctgtacaaacaagggcatagctcagacccaacatccccctgtattctataatcaggccctctggccaccctgagcattagaacttccaccggctctgttttccagcctgacccactcctactccctatacttcaaaattgtaccactgaggtctctacacctagtgttcaagtctgctcaggttataaaaattagatggtaaattttccaaaatgctgtcatctccacgtcatgttcttaaatgctggtagctatgcaatgtatttaactttgaggtgtctctttgttctcttaggaaaaaagcaaactggaatagatgggtttggggatgcctctaagtcgtcatgctttctgagtagtaagaaacagtatgaggccaggcacggtggctcatgcctgtaatcctaccattttgggaggccaaggcgggcagatcacctgaggtcaagagattgcgaagagcatggccaacatggtgaaaccccatctctactaaaaatacaaacacgtagctggatgtggtggcacatacctgtagtcccagctattcgggaggctgagacaggagaatcgcttaaactcaggaggtggaagctgcagtgagccgagatagtgccatttcactctggcctgagcaacagagccagaccccatctcaaaaaaaaaaaaagacattaccctcaaatatttgcatctgatgataattctaaggaagtagtgaggttctacaaaacttatcaattttactctttagtttcacattgatggcatcaggaagaaaaccccgatgaattcttcaatggcctctggtccattctgtaacgtagaacttctaaaactcaagagtagtaacttggacacaaggtggtgctaaggggtaaaaaattaactgtgcgtccttttcccgaaaggttacctcgaatactcaaggttttcggggcacttaatagtttacaaatgttttcacacacattgtcctgtttattcctcagactcagctagtctcgtgttctaaatatataaatgagaaaaataaggtccccttaggttgtgtgacttgtccaagataactcagcccaatctggatctcccttctaagtctaggtttagtgcctttttttactctcctacacaggttagtcccttttttatgtgaagtaagaattctcaatagggcttccatcaacatctgccaagctagggagttctgaatgcaccgatgcaacttacatcctgtgcctcactcgtgttgctagtcaggggaccagtggggtcttggtgactctctctgtgttctcaagaatccttggccaaattctaggatttaaaaagtaacacataaaaatttgggccgggatgggggggatcccaaggagaaaagatgagttctgacgatacttggatttagatccacctgggtagaagacccctggtctaagcttcctgctcatgcagagctgtggcaatgctgtagaaacactagcctgaggctcccagagcaccctctcctggtgcagcctcatctctctcctgatagggctgaaggtctgtctccacatgcgggcaggaaggccctggtcccaccagtgccttcatagccatgtgtcatataagccagactgagaggcctctgcagatggcaagggaaaatcagatggcttctcctgttgagatgatctcctcatagacctaaaatacccacaatgggtggtacatttctggctgtatgagtttcccagagctgccataccaaattcccacaaactcagtggcttactgagtgtattgtctgatagttctggaaggcagaagtctgaaatcaaggtatcaaccgggctgattccttctggaggctccgagggagaattcattccatgccacactcctagcttctggtggctccggtgtcctttgcactccttggctttgtagactcatcatcccaatctttctgcttttatgtggttttccccagtgtctctgtgtgtcacacatattcctgtggcctcaaactcctgggctcaagcaatcctcccacctcagcttcctgagtagctgggactataggtgcagaccatcacaccaagctaacttttttttttttttttttttttggagacagagtttcactcttgttgtccaggctggagcgcaatgggtggcgcgatctcggctcactgcaacctctgcctcccaggttcaagcagttctcctgcctcagcctccagagtagctgggattacaggcacatgccaccacacccagctaatttttgtatttttagtagacacggggtttctccatgttggtcaggctgttctcgaactcccaacctcaggtgatccgcctgccttggcctcccaaagtgttgggattacaggcacgagccactgcacccagccaacactgagctaactttgaaaattttttgtagagataggggggtatccctttgttgttcaggctgttgtcaaacttctgggctcagacgatcctcccacctcagcctcccaaagtgctgggattaccgatgggtccctcttgttttttgtttgtttgttttttaataagaacactagtcattggacactaatctcctaaatccaggatgatttcatctggagctccttactgattacatctgcagctccttactgattacatctgcaaaggccgtatatccaaataagatcacatgctaagattctaggtagacatgaattctggggaaacactgttcaatttcaagcattcacaacttttcttcctttgaactaatcctccaagttctcttcctctgaacttatagaagatggagaacaatggtcactgtcatccccagaagagctcctcatctcccttagttgggacatcctgccagtgctttctctaccaggataacaccagccctcttcaactgcatttttctctacacacaacattctcgtttgccaaggtcattccatggaaccaatgtccagcgtcttctctttccttagatcccacagtccatactcaacctccatgtgaagacagagaatatccttttgagttggaagggatgttgactgacttcatccatttattttgttctcattccgagtctggatttgcctgcgtcccttgtagcttaagagcccttttaattaagacatgactcacagatcatcttcatgtcaacaggcaacaatattgtataccttcgaatttttcaataacgagccttgaacagaacaaactctttgtttcagtgaaaaatgctaattgaaagatttttttttctcaaaaggacattgaacgtaaaccaatgtactaagcaaaatgtagatgatgcctctccttttatctgctgttccttcaaacagaaaacaaagtaccaccccaaccaaccaactcttctggcaggaaaaagaaagagtcctcaaattacgttcttcaacaaagggtcaggaaggaaaagtgaatgtcacaaacaccattcaaagcaccgcagaaagtagtcagtttggtttctttcagaggctggaagaaaacgtccttctcccccgtctccctttgtttttaagttactaaattcctttacgtttgttttcttaggaaagtgacattataggtcattaagcaactattaaaaacacaagtgagaaaacccaaagcgtgggtctttttcctctgatattcttttccctggttttcagaaaacagttttaagagttggaatatttttgttaatgtctttgtgggcatttccgtcatctttccatttgtaacagcccctaaataaggcagctaggggaaacctgccttgtcttagcacacctgctatgccaaaacaggaacatgcattcccccacaatgggatgggtgatttgccaaacagaccagagctcccaaattacctgcctttttgcagtgctacacccaaaaatcaacccgttgactgatgaaatcaacccgtgtggaacttgattttcgacgtcctctcttcctcccacagttggacaagaaaggggaaggaaagagaaaagggagaaaagccctcttcccaccgggtaagtccaggtgagtcccattcaccaccgtcattgccattgtgcgaggctgcagcatggagctggcccccctctagccacaggatcgagctggcttcagagcttccggggtctcatcctcttgcaaatttctttggtggtgaaatctatcaaaggaatctcaaaacagattacatggtaaattatcgtctccattctgggccactctccatgccccgctgtccggctccgacagacagccgtgggtgagctgccggtggaaagcctccgagataagaagattacagaatgtcatgtgcctccggcgactcaacttcacagctaaacttctccagcccaggcagttcatctgattcgcatgggtcacaggctgtttcaattaatgcctctctaatgattcaagtgtgtgccctaatgtggaaggggaatagagagaagtcaagccagggaccttagcatgtctgtcctctccaccctctatctcagaatgctctttcccaagctgacttataagaaaggagaaaatgggatgggaaggaatatagaattcctttcagacagaaaccttttatgtcaccttcctgtcgttaccaatgcaattctgtgagtcttccgtgggctgtggatcctagagtagtgaataacagccctgatacgaaaacagaatgcagaaaacaaatgagcattttgaaaataaaaagcctggcttttaatcctattaagatcatggctgcttttttttttttttaatttctctcccctgccctaaaaactccgaaagagataccgatgttcccattaacataaatgctgaaatcagcatttcctttgaaagaagttgttaatatttggaaatggtcagatttccaatccaagctttgattgttattctatactagccagcaagtgccaaggtcacagggagattcacctgcagactgagctaaatgaatccactcggccacaatgcatgtataatttaacagtctcctcttgagtacttccatgcattcctaaaaaatattttattacaataacaaattggtttcaaaatcatgcattatgtattctgaaattaggtctgccagtgaaacctggatgcacaaacatgcgtactcctgggcagggccggaagagcacacagatgccaggatggagctcaagaacagttaatcccacaaggaacccactgtcgcttctttattatcttaatctgcatatttggaaagtaaaagaacaaactgatcatttactgtaaagggcaaccacccgtttcccttaatcaccccctccatgagaaggcagagggcgtgaagtcctaaaaataggctgccgaggcagtttcccaagctttccttaaaaaacagttattccttgaatattaaaagtcttcttttcctgtgatctgacacttcccgggtatacattttacaggaactggactttaacaaagcttctttgaaacattaaagataaagatatcaaagccatccttacaaatttgtgttaagaaatacacttgctctgccgtaagctttcatcactgagttacccaaaaaaagttaacatattcagaaaaatccttaggattcccgacacaaatgcaaccccatataatgtgtccctaatgggtgcttgtttctgctttgcaactttcatctgaagttaaatacacattgatttagcattcttttacaacatggggatggttttctcatggcacaataaacatgtttcttaagatgtctatttgtgaataattaagactaaaatgcttttctgattccttcctagttttttctagtttagacctttatatcacacttgtaaaaattccatctcatcaaatgaatggcattaataaatcctaagcaggcaggttttccaaaatggcgactttcatgatatggaaggcatttgatcttaaaaacatgagaaagaaatttagttgagttttctctttgaaaagtttcttgggcatgagcttgatctttctatattaaaagaaaaaaatctagtttatttcaataggggattggttttcattaacttgcaagctaaacatcattggtatgtttctattggtgtactgacttggtgaataaaacaacaaattcttgagagagtcacttataaatctctttaaattaaaatcagtctaatttttattataagactaacatcatgataggcttagtatttttaaggcaatgcccagaactaaaaagtttaattccctgacaagagcttttaataaagacaaatcataactaaaattagatgctgcaaccttttcttctcaaaaaaaaaaaaaaatctgcaaacactgtgttaagacatcattcctccttaattttgtttcgatggagtgatatgactagacatatagcttttctatagttaaattataaagaataattttctctaatctaatcagtaatttctaaaaatgggaaatggtaacagcataattttttatttcttttgtattataatttaggctgacacattaaagctttgcttttcaggggaacaattaagaaattgttgatagaaattaaacattactgacaattgaaaatgcatttttttcctcattcgcagcatctagatataccgctcctacctcccatcaaagataatctaagctcagatagtattaaagtaaaaatgaacgaaaaagcttagttcttttgtgctaaacaaaaaggtgatttatataagtaataagcaaattccagagtatggagatatatgtgtatttttaaatcctctaaaaatgccttaagttgtaatcttcaggctaaatgattaaactctctctgggtcctttggctgtagaactatatccttcatgttagctgtgggctattttcggctgaatgcaaactgcttttttgttattaaagacagttcatgttttacaccacctttggtgtatggtatacagaccaacacacataatttaggtcagtattaaaatagaattaattttttttaaaaaaccttcaataataattacaataattacatttccttcccacacattgcaacaaatagttacatagcctacttcttaaatactggtgtgaaaacactaagtcgaaattcatgacacaaatcaaaatgtgttgcacaaacttctttttggttgtcgtgaaaggggtgtctcaaattgagtgtagaagggcattccaataaccatagtactttttttggctgaactgtaaatacataattcatatattaatatgataaaatatataagatcacccatatagtaaaaattaaatcagtgaaaaggactaaatacagttacaaataagcagcccagaagttctaagggaaaatgccagaagtcaaaatgctttctgattcatcttaagcagaacaggagttttaacacaagcctctcttaacagctacccaggcaggatttgaggagaataattccctaatgccacttaaaaaagaaaagtcaaccgaaagcatcaaatggattttgaatctaaatattcttaaaaaaaaaaaaaaaaaactttttctgaattggcagc

SEQ ID NO: 2001 - DNA, 114268 bp, Homo sapiens
aagttccttcacttcgactattacttccttttcacaattctattttggacttctgtccagtgtgtatttacaggtagacaaagctttttttctttctttctttctttctttttttttttttaacaacctctttgccatgactgaaaagaagcctgtatatcctgcagtttctgggcattgtgagtctccttttaaactcaaattggtgataatggtgactgtgactccctattgtccaaggaggggagttgcagatagggccttcaaagatgatccaataaaaatcagtgcagtaagactttttgataaaatgatctttatgatgtagaggcatttggaatatgggttgggtactggataccctggggctaagcccagtgtttaaaaatcaaggcttactacgaaaaggtctgtttttattagtgcaggtactgtagttggcaagatttcttcttatgaaatgcaatatccagcagaccattcctgattatgttatgtatttttagatgttaccattgagttatatttatagtatagactactgaatcttatcttaaatatgcaaaatatatgcataactaacctcccaagctgcgttccctgctctatattacacccaacaatgtagcctgttcttaaatggttctcctaaaagtcttagaatggagcttattatttgcttttaaaatgtaagcacagagactgtgtgttagatgtgtggccttctgggtgacatgttctgctcctagatactctaagggtgaagtcagcaaacctttggcagtgcaggtggggagtgaaaccaatagtcttgcatagataactccccagagtccagaatgagccaaaagtaattgatatgccagtctttgccagcatgtttggtgaatcagagcagcaggtgtctgttacggtattggggaaggttaaatcaccgactgcattgctgatgtggctcttgcttgtgcccatcagcttcccagtccccagaacccccagagtcctagactctcatcattctattcctcaggacaacataaatattatcaggagcactgtgagcacagtcctgcttctgctacttaaagttgaagggaaacgagtatccttacatctctgtatcccatgttcccctgtcttcatgaataagtggtttgattgttttgaggccaacttgagtttatagagcttgtctaataaaaagatggatgtccttggggaaaaaaagctgaggctaataaggtgagagagaaacggaatcctttcaatgagctaagaaattacttcaattgaaaagcctgggaagtgaccctatcttggtcaacatatttcatgggcaaggtctggggatgtctggtgtcttcccaacccatgaaggcacccatcccacctgggtttgccctttctagatggtggcccatctcaaggatatttttctttctttctctgatccaaatccaaggactatgttctagtccttcagaaatctatactaacaaactggataagtgattctgcctcaaagttgcataactacagaatcattggtcaagttcttactgcctgctcacttattcatcaggaacttattgtgtacctgccatgtatcaggtactctactaggtgtgggggttacaaagatgaatgtagtgcagtccctgaactgaagaacatagtctcatcatggatgaaagtactccactaacataagatacattattattgtctaacatatgtgatgttattatgggtatggtacaagatacagtggaaacagagatgagaaagctgatcttttacttggagtggttggctaagaattctcatttcagtatggctttaaagaattcaagatacggctgggtgtggtggctcacacctgtaatcccagcactttgtgaggctgaggcaggacgatagggataaattgtttctataaaaaaagtaaaaatgttaggtgggcgtggtggcacacgcctgtagtcccagctactcaggaggctaaggtgggaggatcacttgagcctcggaggttgaagctgcagtgagctgtgatcacgtgagacaaactgataccctatctcaaaaaccaaccaaccagaaaaaccccaagaattcaaggtgggagatgcagaaaaggtaatagtatcctttgcagacagagacacaaaagcatggacacgcgaatgatactgtgcaggaatagtcaggactcatagtcagctgatatgttttagtaaggctccaccagtgcttatacaggtgttcattctgagtagcctgtgcctcggtagtagctaataatgttgaacatcactctaggagtaatcacagattgcctgaaaccataggggttatacatgagggaaagaaggaagaagaaaaagtgggatgaaaggagaccagttatgaaggcacttgaataccaactaaggagctgtgtgtcaccaaattgtagttactgactcattcatttatttatacattccctggaggcagggataccagatagaagactagattaagaatccaatcaagaacaaacaattaattgagctaaggcagtattaattgaaatggaaaggaggattcagataagaaagatatttttaagaggtcagtgttctgactctggtgactgtctatggtaaaagcaagaaacagagaaatgaaatagaatctaaggtttccatattgggtaacagtgtgtcttgtatgtgctcagtaagggttgttgaattgaacacaatgttaagagcggttttctaatgcttttctccaaagttgaaattacagcagaatttcaggttctaaggcatgagagagagagagagagagagagagagagagagagagagagagagagactgaggatctgatgaatctcttggtgttcaacgtgttggcacagtaagcatttcccaccaataaatgatctgtatagtgattgtgataaactgagtttttgaaggatactctatggaggaaccatggttaatgtctcaatttgagaagagaaggacctgcagataagtgtgaatggctgtgtagactgaactgtacattttggcttgccctagccatgagaaagatatatcagatttaaatagacaaggtttttgttacctacatagactataaaagcgttctgcttttttagtagcacactatccaaaataatactaattacccaaaagtggggaaaaaagacaactgtaataagctcagagtatagttaaaaaccaaaatgattattgtgatgttcaaggaacatgaagtctaagtcaaatttgaaagcttctgttgtgagttgatttgtagacttttatggcaaattttggattcattgtatcatgttttgtgactgagtttgatctattcaatggcttgacaggtcctttagtaaagaagacctgtatctcaatgagccattactgaagttgtaatgagtagataggcaatgtcttgatgttcatacagctctgctcaagtggtctgtaattccttgcaatgccgcgaagaaagcactgggctaagagttacaggatcagccctccatttgccagccacatatctgtaaacaaatccctgaacctctttacacctcagatgccttgtttgtaaaatgggaataataacagctgattcggtataacccaaagggctgttgtgaagatcagaagagatactccatgtgcaatttctttgtgacatataaagctctgctgacttgtgatgctattactattgagaaggccacataggtggaatggttaaaggacctatggaagaccactacgtatgatgttaaggacagtaataggctgggacagtgaaatgtggtagtgccctctcttttttctggctgcatgggtaagctgagactgcaggatgtcactgtcttgagttgttgctccgtgctacatctgaatatattacagtagtaacgtactttcagagagctgacaaaattgtagtcagagatgatctttttgaagcaaaggactcttagtcttttattgtggatttatgtagctcaagggatatagttaagaaccaaaataaccattcctggatcttaagagacaaaggattcatagcagcagttgtttttgctgcacttgtgtttatctccttaaatgtgcacgaatatgtatatgttttttacagcatggggaaactcatgttaaaattcattgaaaccattaattggaagcagatatacttctattacatgttttgataatctgtatttacaaacaatttgtattatttttctattcttttttgttatctacctacctgaaggcgagtttcctattatttctagttcaggcttataagaatgactaatatatgaggggaacttctaaacagtctattactctgcagcccatttggataaagaagtgtgggaagatttgagaataagttccctattgtcatcaacacatgttgaccactgacccttctttcttttccaggcaacttaaagtggtcttaatttgtataaaattatatatcaattttgtccctaaaaggtgtggatcaggctgctaatctgattttgtgggtgtgaggagagggaagcatatatagcctatgatgtatgaatacatgtgatgtgcacatatgtacagcagatccatatccctgaaacattttaggagaactccttaaatgaccatattctacttgtgcagctgtggcagtaatgataactttggtttaatatggattattggaaatggaaatgcaataaatggaaactagtgtatatcaatatagaaatgcctattcattttcattaaaagagtattcagataacattttcataaatgttagaccaatgtgtcatgtggaggcagttattaaaaagactgaaggcaaggggagttgtttaactttaaaaaagacttgatatttgtaagtcaaatttatatttccatcccagatttactctgcaactcaggtttggagctgtgaagtcaaaacccaactattacatgcccagccacaaatcagcatgtcatggagagttgttgtgtgtgtttttgtggaaataagtgggagaagttaactgctgttgaattgttggaaattattggttaaatttgagttatatttgcaaatacacaagtatcaattgtgcaaagtgacgttaaagatgaaaaagattttttaaaaatcacactaactatgcccttgatggaagttacctttcagagctgcttcacttacattctctaaaggtttcctgttgctttctattcgttattcttaatttaaaatcaaattgtgccattgagaatcaagaatgtatcaagagcatttacaaaatgtttcagactacaatgtaaaaaagtaagaatgactaaatcttgaagctcacacttgtcaatttaggatagtctataaattcaaattcaagtaaatttaacttttattttatttacttttaattatgaagcagatagcatctcagttttctcacctattaggtccagggtgagaggagagagttacaagttatctattagcatggttcttatgaaagtaatatcagatatggtggcatgtctaaaagcactttgtaactataaagaacagtgtgagcaatgtttgtatttattattattattatttttgacacagagatttgcttttgttgcccaggctggagtggagtggcactatcttggcccactgcaacctctgcctcccgggttcaagtgattctcctgcttcagcctcctgaatagctgggattacaggcgcccaccaccatgcctggctaattttttgtatttttagtagagatggggtttcacaatcttggccaggctggtctcaaactcctgacctcaagtgatgcacccaccttggtctcccaaagggtgatattattattatagtaaatatcacattgaacaatttttatctaaaactaatgtcagaatgtccatttcttgatataaaaataaaaaagtttgcttttcatttttatctttctgtagagatgttgctttctcattgacacagaaatcaagactgttcagatgatgttaataaaacagcacatcaatataatttttgaaggagatttataaaaatgtacattttaattgtcattaaatcttaatacttattgagcaccaaggatgtgatgagaagtagcctgctaggtctaatgacactacttagctgtttgaataactaaatagcacatttctatttagagaccatataagtattataggtattcttggtgatgttataaagttcttcaaagaaaatatgtatttatatctggctttatatattggggcaaaaatagcaataacactttcaaaatagtgacggaaaaacgagtcacaataaatacgttggattctgaagataaaggagtatataattctcagagttacaacatctgtctataaaaatagtgcaattgggatatactattttagtaagaaactcattaagtgtaattttaaaagctgctgcttttttcttaagtttgacattccagtaaactcttaggaaaatgtccttccagttgcttttcctctaagtgtctagaagtggaagtacattaaaattaaaagcagaaagtcccttaaattccttttaagaagtccatcctgttagtctgactcctagaaaggctatggttgctattactttgggctggaacaagattacaaaagacctcaagaagaagtggaaattatcatgggagttttctgtcactcttatagtttatggcctttttgttctttttttagtccattaaacatttctttttgccaagaggtcctatctgtaaaaggaagtctttgataatgatagtttaaaatgctatgtaatgagatacttatatgcaaaaatccaaaaaagcttttttatttctataataatgataatagcaaacaaattatagtgaacagtaaacaataagctaattataattatgtgaattgctttctccctcactgattccttctatacctattattttatttctctgttcacaatattcctgtgctataagggagactgctaaatttgctcttttttagatgaagacttagagacctgtaaggttgatatgactgcctcaaagacacatggtcgcgctgtggctgagtcgacactcaaggccagttctctgtgtttctttttcagtgtgacttgatatagcttgtatcttaaacactgcatttttcttatgttctaggtttctcctctgccaacccctcctggaccattgtcagcagttgaacgacaaaggctgtgaatctgcatcctagtcttagcagtccctctgattctcatgatgagctcacctgcacagcctggtcagtctggttgcttcttaaactgttaatagacttcatgtgaaagatgttgctttgtgttgtttcaaaccaagtaatttaatttatgaaggaacttttttttttttggacaaagattgcttaatgtaacaaattttgaattttgcattcgatagctaattctctattgcttaacccagtttgcttcctggacaactgatttgatttgcattgtagtctgagcatgggactttaattcttctgcttccaaggtaacattcagattgaactttatgaagttatgaatatgaactattatataggaatccatttttcacctgtaatctttctgtcctaacatgtgtctgtatgcttttaaattatactgtggggctttggaagtcagtttgtggattgactccacctccatctctttgacacacaggaaggatatttttcctccccacccttctttgctgccattcctgtttcctatatacatatttaattataatctcagcacctgcttcctcctattccagtgatgtgtgctgctcatgtagtgctgtgatcagcacagccaacacccgttcctccaggaacaggctgtcatttttggagcaaacacaatccaagttttgggaatgatgaagtagggtcagataccacatactagtaacagacaagttttacaagaattttctgcttggatacttacagaagcatttatttctttatagattccttagcatattgatatccttggtttattgaactaagttgaagcttatgtactatcatactcagggcttataagggagacaacttgccaagattttcattccctggattgccacacccaagttagctgtttgggaattccgctgtttcatcaacctttccccacatccccaacaggcctccaacttgtatgctgaatttggaacttgattctaaatggtgcagtccagaaatccctgagtctttagtcacaaccatgtttgataattggcatgtcactaggttaggcagatggcagttacttacttatgcctgttagctctgagtctttattgcctagtggttctcaaactttagcatgcattgacatcactcggagagtttgttaaaacaagccctattctcatagtttttgatttcgtaagtctagagtggggcacaggaattgtgatttttacaagttcccttgacaatgctgttgctgcttggggaccacactttgggaatcactggtttagcttcttctgcccatttctcaccccatcccctaccagcctctacagacaaccttgtttaagtgtgttctgtgagcggcattgcttattacaattatagtctagtactattattctttctgttgggatgaacttaaattaacatttaccttatataggtgtatattgcattttaaatattatgtatatttatttgtatataaattcagtgtttcaaaattggattgtttaaaagaggcattaatttagaaccactgtggtcaagtatttttttcttgtgataatatttggcagtggatgttggtctaccctgctccccaagaatgttgattttataaaatgaaaatctcacttgaagctgctattttgatgaggaaattcttgcgagttgtgataattgttcagttatgaggagagaaaaggtgatggataaataagacaaccattgaatgaagctcacttgactttagggtcaccaaaatttcctcgtgtacttttttcttataaatcattctgctgtgttgacaataacattatgcagaagtctcaatcaactccatttgggaagtttttatgaatgaaatctgaagttgaggaaagtgatagtaaatgtgccaggtgggtaggagtttcttctatttattgcaagtaaaaaaccatgatcagagacctgaaattcactttgcatggataaaggaaaatgttcctgccacaaacataaaaaaaaattttctcctgttattagcctgcatcttagggtgccgtatatattctgagaaataacctgattgtttgatttagaaaaaaatatgtttttcttacatcttttttccccactatctaaaaagagaattaaattggtcttatgcaatcatcatccatttattttgcttttgttccacaaatggctctaaggagttattgtgcaccagaaagaaaaatagactcacttcagtagttccagaaattctttaatagtccatgtttcagactgagtatgtttgtcttcaaaattggttctggtatagtgtgaattcttatttttcccatacattaacatcattcttagaaacgttctccatccatattcaaatatggttgatatgaaatacaaaatgccgccgtcttaatcatgcattcagtcaaacaataagtgctgatttttgtatataaaatttactagtttttattttaattttgctgcccagttctgttcaaagttagagccttgggtattgcttttgggcactgaggatcctgaatggaggaaagactatctggataagattggcagctagctgctgcagttgagctcttcattcaaaacttattaagcatctaacttgtgccagccagtgtgttacccaatagggacacaacaagcactaaaacatagtttctatccttagggacagcaccctttcatgggagagacaaatagtaatagctttagtccatttagtgtcttaagtattttaataaatttaggaccagaaatttatttcctctgtacagcagtatggatactatttctagtaatgtaatttttatcagaattgccaaatctcagaaggaaggattttaggacttatctagcattttcaaaacatgtcagatagtaaaaatctcctgagacttgttaaaaatacagatttccagactcctccctgaaagagtatcgtgtggtagcctgggggaaggatactggattgtagaatgtatattgctctttgctatgacttggcaaagtgtagaaatgctcttagtccattcaacagcactagtgtttcatatttggagactataaacacaaaaacacatcataaagtcttatctcaagtaaatgtttctcttgtgagcaaaactatgctaattcagttattttgttctctgatgatagataaataaaaagctaacactggctaggtgcagtggctcatgcctgtaatcccagcagtttgagaggcctaggtgggaagattgcttgagccccggggttcgagactagcctgggcaatatggtgagatcctatctctacaaaaaattttttaaaaaattgcttggcatggtggtgcatgcctgtagtccctgctacttaggaagctgaggtgggaggattgctcgagcccaggaggtcaaggctgcagtgagtgagccatgatgaagccactgcactgcattctagcctgggccacagagcaagaccctgtctcaaaaaaaaaaaaaaagaaagaaagaaagctaacacagtggaaacctagagaaggcaataatttgaggggaacattctagtggctttgcgtctatctaggccatctcatttttatggggaggtggatggaccaaagagatttttatggagtgcctttattttcctcaaaagaagtttaagcatattttaacccagggcagctttttagtccgatctcaagattatagaaaacctaatttcagcctgaacgtttttaaataaattgggctacatcaaccctaacatgatttttaaatttgatgaatctattttttgtaattaattttgatgaaaacgcatccaaaggaattttccaagcatagaacacaatgtgcctgttgcccttagaattgtgcaatgctctggccttgtgggcttctaggtaaagtggccaaagctgtgttgcaaagtcctgtaacattagttttcaaagccccttgtataaagctagctcatctctcttttcaccattgtgggaagtactctactcatatgaagtgagaggaccaagctatttatagaagtgaaaggtttatagcaagatcttatattctgttcattttctcgtattctattcattttcttattggcaagtcttgggcaaaaattaattaagagatttatcttcatgcctctgttttgctaaacagctgaattcccccatagaaatgtagagtacatgtaactaatgatcaaaaagttctttgaaatataaattgttatggaaatgctaagtagtataaacaatttgggggcaagcattaataaaagcttctctgcaagcatttttaaagaggactaataaaagcttcatggttcaattaatacagcacaacatcaggttttttagaagcatatgggacccagaaggcctgcccctgtttttaaaatttacgaactctttaatgattcaccatttttactccagtgcattacccacagtggtgccatttagccattaagtaggaaactaaaaccaggacaaagctacaaacaaatatcataatgtccaagtgggtattttttcttcagtttgttcatagtgtgttaccaaaaaaatgaatgttaaatgaaacagagtcttagggcaaatcaaataggttatggcttccctagatgagtatgatcagttagctttttaatgaaatacaggtcaaatcccatgacaagtagctctacataactaaaatattttcaggccactggccaattatctatttcaagtaatattcaagaaaattattccaggataataaaacaaattagttttttgatgtttgttgtagcagaagttgatcacagggtatggtattaatgggaaacactgtatgttaaagttattaactattgttttggatttttttttttttttactactttaacttcacagttaagtgattcattcttttgccatttgtaagtcaaaacttctcaatctgatattcaagtttgaaacataaaccaaatgaagcattttattcattctctagtttttgaaggacagtgctttaataagtgaggcataaaccttttctgaaaatgttcagtataaatttgttttgaacatttatttgtttttatatttgcttttcacaattaattttggtgggtaattcaacttatataattttcattattgtaacactacaaacaaactccataatgcaggccaaacagaaaaggttatttctcgttcatataaagactgagtagagagctgctgtttttctaatggctaccctttgccccggacagcttctaactggtttgtgcttcttcagttcatgtattctaaggtcattgtgcatctccgcatcaagctggtgggagggaaattgaagaggtgcattgagtgtgagaggtttccaaaggtacatcacttttgttcacatttcgttgagtggaatttagccacgtggccatacctaactacaaaggaggctgggaaaagtagtctagcagtactccaggaagaggaggagacaggtttggtgaacagctggcctctctctaccacatttgtcttaaaattttatacctaggactgcagatacggtattgcttaccaagaggtgcagtattttataatgcactcttgatttaaccagtcattaaaaagttaagtaattttcctttgaagagattgaaacacattaaaatcagggcagatcagctcaccaacatttctaagagttgcctaagcctttgtttatgaatcatgcagaatagataatgcccagtgtagctattagaaaattcaagttcctgttagtgggaactctgcagaaaatgggagtaaaatgtatgctgaatattatatgtccttaattagtgtttaaaaataatgtcaatttatctgaaattataattgcacatatgctgaggaaaaagtactttaaactttataatcacaattcttatgtttgttctttattgcattttggggtcacgtttttcaacacctctgtagttttaagtattatgatgaaaatctaggccaaatatacagtggttgataaatacttgttttacactgatcttttcatgaacactactataaaacaatgctagactatatattttcttaagccctgtaagcaaaatcttgctacctctgcaaatacacatgtacagccctttgtttataacattatgtggaacctttatggaggatttttttgtctgtatagattggagtttactcttcagagtacaaaaactctgtgtgtgtgtctgtgtgtgtgtgtgtacgtgtgtggtgcatgtgtgcttgtgttgcagtactataataactctagggaaacacaaaggtatgtggaaccatgtaacctgtacttttacactaaatatcccccaaggctttactttctgtggttttctgcatatttcttaatttttgtcatattttgagaatgtcaacgtatagcagttttctccatttataattcactgcctctaacttgttgtagggttagaaagctaagaattgtgttaaataaaattgttaaaagatcacaagttctgaggaggtgcaaatgtcttgtttttttttttttttttttgtgtgtgtgtgtgtgtgtgtgtgtgtgtgcgcgcatgtgtctctgtgtgtgtgttttaaatagagttttgttcttgttgcccaggctggagtgcaatggcatgatcttggctcactgcaacctccgcctcttgggttcaagcaattcttctgcctcagtctcccaagtaactgggattacaggcatgtggcaccatgcctggcaaattttttgtatttagtagagatggggtttcaccatgttgctcaggctggttttgaactcctgacctcaggtgatccacccacctcggcctcccaaagtgctgggattacaggtatgtgccactgcacccagcctgcaaaagtattttttatgaacaaaatagaagtacttgtttttcttacatactgtaattgcattttaattgtctccttatccactgcacccctcttattttctcggttcttctgtctttagtctatagatttacagaattttgagtttccagcgggtgaggcatcgttatggttttaattttgccatacttttccttgcagttatgatacatcagtttttttttctttttttttaaattatactttaagttgtagggtacatgtgcacaacgtacatgtttgttaacataggtatacatgtgccacgttggtttgctgcacccattaactcatcatttacattagatatttctcctaatgctatccctccccctgtcccccaccgcacgacaggccccggtgtgtgatgttccccgccctatgtccaagtgttcttattgttcagttcccacctatgagtgagaacatgtggtgtttggttttctgtccttgtgatagtttgctgagaatgatggtttccagctgtatccatatccatgcaaaggacatgaactcatcctttttatggctgcatagtattccatggtgtatatttgccacattttcttaatccagtctatcattgatggacatttagattggttccaagtctttgctattgcgaatagtgccgcaataaacatacatgtgcatgtgtctttatagcagcatgatttataatcctttgggtatatactcagtaatgggattgctgggtcaaatggtacttctagttctagatccttgaggaattgccacactgtcttccacaatggttgaactagtttgcactcccaccaacagtgtaaaagtgttcctatttctccacatcctctccagcatttgttgtttcctgactctttaatgattgccattctaactggtgtgagatggtatctcattgtggttttgatttgcatttctctgatgaccagtgatgatgagcattttttcgtgtgtctattggcttcataaaagtcttcttttgagaagtgtctgttcatatcctttgcacactttttgatgggctgggttgttttttttcttgtaaatgtgtttaaattctttgtagatttgtcagacggatagattgcaaattttctcccattctgtaggttgcctgttcactctgataatagtttcttttgctgtgcagaagctcttcagtttaatgagatcccatttgtctattttggcttttgttgttgttgctttcggtgttttagtcatgaagtccttgcccatgcctatgtcctgaatggtattgcctaggttttcttctagggttttttttatggttttaggtctaacatttaagtctttaatccatcttgaattaatttttatataaggtgtaaggaagggatccagtttcagctttctacatatggctagccagttttcccagcaccatttattaaacagggtatcctttcccatttcttgtttttgtcagatttgtcaaagatcagatggttgtagatgtgtggtgttatttctgaagcatctgttctgttccattgttctatatctctgttttggtaccagaaccatgctgttttggttactgttggcttgtagtatagtttgaagtcaggtagcgtgatgcctccagctttgttcttttggcttaggattgtcttggcaatgcgggctcttttttggttccatacgaactttaaagtagtttcttccaattctgtgaagaaagtcattggtagcttgatggggatggcattgagtgtataaattaccttgggcagtatagctatttccaagatattgattcttcctatccatgagcatggaatattcttccatttgtttgtatcctcttttatttcattgagcagtggtttgtagttctccttgaagaggtcctcacatcccttgtaagttgcattcctaggtattttattctctttgaagcaattgtgaatgggagttcactcatgacttgactctctgtttgtctgttattggtgtataggaatgctggtgatttttgcccattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcttgcctgattgcgctggccagaacttccaacagtatgttgaataggagtggtgagagagggcatccctgtcttgtgccagttttcaaagggaatgcttccagtttttgcccattcagtatgatattggctgtgggtttgtcataaataggccttattattttgagatatgttccatcgatacctagtttattgagaatttttagcatgaagggctgttgaattttgtctaaggccttttctgcatctattgagataatcatttaatttttgtcattggttctgtttatgtgatggattatgtttattgatttccgtatgttgaaccagccttgcatcccagggatgaagccaacttgttcgtggtggataagcattttgatgtgctgctggatttggtttgccagtattttgttgaggacttttgcatcgatgttcatcagggatattggtctaaaattctctttttgttgcgtctctgacaggctttggtatcaggatgatgctggccttataaaatgagttagggaggattccttgtttttctattgatgggaatagtttcagaaggaatggtaccagttcctctttgtacttctggtagaattcggctgtgaattcgtctggttctggactttttttggttggtaggctgttaattattgcttcaatttcagagcctgttattggtctattcagaggttcaacttcttccttgtttagtcttgggagggtgtatgtgtctaggaatttatccatttcttttagattttctagtttatttgcatagcggtttttatagtattctattctctgatggtagtttgtatttccgtgggatcggtggtgatatccccttaatcatttttgattgcgtctatttgattcttctctctttccttctttattagtcttgctagcagtctaccaattttgttgatcttttcaaaaaaccagctcctggattcattgatttttttgaagggttttttatgtctctatctccttcagttctgctctgatcttagttatttcttgccttctgctaccttttcaatttgtttgctcttgcttctctagttcgtttaactgtgatgttacggtgttgattttagatctttcttgctttcttttgtgggcatttagtgttataaatttccctctacacactgctttaaatgtgtcccagagattctggtacattgtgtctttgttctcactggtttcaaagaacatctttatttctgccttcattttgttatttacccagtagtcattcaggagcaggttgttcagtttccctgtagttgtgcagttttgagtgagtttcttaatcctgagttctaatttgattgcactgtggtctgagagacagtttgttataatttctcttcttttacatttgctgaggagtgctttacttccaactgtgtggtcagttttggagtaagtgcgatgtggtgttgagaagaatgtatattctgttgatttggggtggagagttctctagctgtctattaggtctgcttggtgcagagctgagttcaagtcctggatatccttgttaactttctgtctcgttgatctgtctaatattaacagtggggtgttaaagtctcccattattattgtgagggagtccaagtctctttgtaggtctctaaggacttgctttatgaatctgggtgctcctctattgggtgcatttatatttagtatggttagctcttcttgttgaattgatccctttaccattatgtaatggcctgctttgtctcttttgatctttgttggtttaaagtctgttttatcagagactaggattgcaacccctgttttctttttgctttccatttgcttggtagatcttcctccatccctttattttgagcctatgtgtgtctctgcacgtcagatgggtctcctgaatacatcacactgatgggtcttgactctttatccaatttgccagtgtgtgtcttttaattggggcatttagcccatttacatttaaggttaatattgttatgtgtgtatttgatcctgtcattatgatgttagctggttattttgccagttagttgatgcagtttcttcctagcattgacggtctttacaatttggcatgtttttgcagtggctggtaccggtttttcctttccgtgtttagtgcttccttcaggagctcttgtaaggtaggccaggtggtgacagaatctctcagcatttgcttgtctgtaaaggattttatttctccttcacttagtttggctggatatgaaattctgggttgaaaattcttttctttaagaatgttgaattttggcccccactctcttctggcttgtagggtttctgtagagagatcagctgttagtctgatgggcttcccttcgtgagtgatctgacctttctttctggctgcccttaacagtttttccttcgtttcaaccttggtgaatctgacaattatgtgtcttgggtttgctcttctcgaggaggagtatctttgtgatgttctccgtatttcctgaatttgaatgttggcctgtcttgttagtttggggaagttctcctcgataatatcctgaagagtgttttccaactcatttccattctccccatcactttcaggtacaccaatcagatgtagatttggtcttttcgcatagtcccatatttcttggaggctttgtttgtttctttttactctttttttctgtaaatttgtcttgttgctttatttcattaatttgatcttcaatcactgataccttttcttccacttgatcgaatcggctattgaagcttgtgcatgcgtcatgtagttctcattccatggttttcagctccatcaggtcatttaaggtcttctctacactgtttattctagtgagccatttgtctaatcttttttcatggtttttagcttccttgcgatgggttcgaacatcctcctttagcttggagaagtttgttattactgaccttctgaagcctgcttctgtcagctcatcaaagtcattctccgtccagctttgttccattgctggcgaggagctgcgatcctttggaggagaagaggtgctctggattttagaattttcaacttttctgctctggtttctccctatctttgtggttttatctacctttggtctttgatgttggtgacctacagatgggattttggtgtagatgtcctttctgttgatgttgatgctattcctttctgtttgttagttttccttctaacaatcaggaccctcagctgcaggtctgttggaggttgctggaggtcctctccagacgccgtttgcctgggtatcaccagtggaggctgcagaacagcaaatattgctgcctgatccttcctctggaaacttcatcccagatgggcacctgcctgtatgaggtgtcattctgcccctgctgggagatgtctcccagttaggctacatggcggccagggacccacttgaggaggcagtctgtccgttctccaatctcaaacaccatgctgggagaactactgctctcttcaggcctgtcagaaggggacgtttaagtctgcagaagtttctattgctttttgttcagctataccctgcccctagaggtggagtctacagaggcagcgggccttgctgagctgtggtgggctccacctaattctagcttcctgagcactttgtttatctactcaagcgtcagcagtggcggacacccctcccccctgccaggctgctgccttgcaggtccatctcagattgccacgctagcagtgagcaaggttctgtgggtgtgggacctgccaagccaggagtgggatataatcttttggtgtgccatttgctaagactattggaaaaacgcagtatttggttgggtggtgtcccgtttttccaggtaccatctgtcatggcttcccttggctaggaaagggaattccccaactccttgcacttcccaggtgaggtgatgccctgccctgcttcagctcaccctccatgggctgtaccctctgtccaaccagtcccagtgaggtgaaccaggcatctcagttggaaatgcagaaatctcctgtcttctgtgttgatcacgatgggagctgcagactggagctgttcctatttggccatcttggaacggaccagtccatagttttataatgcatgcctatgtgttgatttgtgttgctttggagttgctttaatatccaaatgaaagactcatgaccatattattggtgaacttttaaaaaatattgtattgatttataggaaattgataagctttgaggtaatctgtaaaattatttttaacccccccccccctttttttagaataacttcctggcacttgattatataaggctcttgctgcttatgatagatggttgctcctcacatatcattgcataattaaccttttctcccaggctcttaatgtccaagaaaatgttctcttcataccagtaatgtagttccactggaaagtgttctgggtgagctggggatttttcctttggagctggaatttgccctagtaattctgccttctttggaattctgtgagttctgtgagagggcagataatcatagtggtgtatgaccaagcactcaccttttatctttaactctcagaagaaattgtttttcagaaagaaatgtcaaaatgacattattcatgagaaaaactagtcatgagttttggactctctaggaatgtaaacatgtttaataaaagctggtgacagtttttcggtctgctgttactggaaagcctgcttgatttccttccctgtgtttttctggtcttgagatctccagtgctttctgaagatccaggaatgccgtacaaatgggaaaagccagactgttatcttgaacctctgtttttgaaatctctgtctgataaggaaaaaaatattgcaagtcattgtagttacttgtttggtttgtcactggaattccaaatatttgcttggtggttcatggacatgtaaattttgggatatgttactattgtttagggtatactgtctgtaaaataagttattaacccagtgactgttaactagatcttccaaaagccctgtctcctatcattttatgtgtattgaaaaattattataattagagatttttttaaactcttagaaaatgaaagtatacagctatgaaaattctgtttgggtaattttttaaaaaatttattttcagttcagaggtacatgtgcagatttgttatacaggtaaactgtgtgtcacagggctttggtgtacagattatttcatcatgtttggataatttttatgttattttttaatgcatttttatccttttgtctgtattattgtgcttccttttttattaaagaagagttggatgtatcttactttggctttatgtttaaagtgaaacagtaaattgaaagattttaacaggtcgtggtatgtcaatgaaagaacctagaaattagcagaaaaatgcaggaagccaactatagatattggaaaaataatacataccataacttgagttaggtaatgtacactatcgagtctttgaatttcaataaagtatgtcaaagtagacattgtatgtcattttcccttctgttgggagaactgataatccgcctacccatctgccttcctacctttcttagttttctttctttttcttttattctgcctaagtccagaaaagatttggggtctatataagtaagttatggaaaataaaatacgtgaggaggaagggaaatgaagggaaattgggtacaccctgttagtacctgcatttaaattctgtgaagttgcttgaagacggatggatctgtgtctgagcttcctgattagcaagtctgttgtctatggtgcgattaatctcttctcagcctaactctgatatagtcactgccctgtataagaaatgtcagtggctctctatcacatctatttaaggtatataagaacccgtacccttttcaggcttatcttatttttctcctcaatgaaccccactctgttcaacatgtagagctgcttaccttccccaggtccagttttcttgcttggaggcctttgaatgacccttcctcaccactgggagtgtcctgtttacttatcttcaacacccagctcctactccattcttctgtgaggccttcctgggtgacgctgacatttgttacctctctcagttctggaacttaccttagtactggggttgtcttctctaataggcttagctttttgagggcaagggacatctaagtacattttgtggggtgtatatagagtgaagcagttggcagctgtatttatggttgctctcttagttaagtaatatactgcccagcacacaaaaggagccaaataagtgaagaataaagggcactttgtgaggaggctgattatagtggtgctaggggcatggaattggggaggagggaagcagttgaatatacctgagcaaaaccaaactgtttcatatgtgtcatgaatcatatcccttttctttttgcttattcatttgttgactttcggttcttttcacctctagtgctatccactgaacttcctccatccccctacctccccttccctcccgttccctcctccacctcccctcccctcccctctcctctttgacagagtcttgctctgtcacccaggctggagtgcagtggcacaatcttggcttactggaacctccacctccctagttcaagcaattcccttgcctcagcatcccgagtagctgggattacaggcacatgccaccatgctggctaattgttttgtatttttagtagagacagggtttcactatgttggccagacttgtctcgaacttctgacctcaggcaatctgcatgccttgggctcccaaagtgctgggatgacaggcgtgagccactgcacccggcccccctctttctaaggtggcttatctattcattgaacaacaaacattgcaatagggtagtcattgtttgcaagacttgtggtttcatactgagttctctaaatgtggggaagttgctaagtttggctcttcttcagctagcacagcggtagaagcagacctaccaccctctttccttttagtaacttgaacttctccctgtttcaatgcttataaaccacctctctcccaaaacaaatatgtattgtggttaagaatagtggaaagagtgacatgatttttaattgtggttgagcaggaaattgttttaagttagtttagaattcattgatccaacattctttatacttttaaaaagtaatacagttttgcatactgtataattagcagtaacttttaaatatactacgtttctgaggaccttcagtaaaatacatagaaaggaaaacatccggcttaaaatttgtgacttttcaatctgtatacattttcagttcctcttatttaaagtgatagactaataaatattttaatataatggttgaagtctttattaagattaaattaggatcttaaactttctgtgtgtctccattaaagatgtgtttttggcttcattatttgacagtgttgtggtatggcatttaatggagaacaagatctcttactttggaatgtatctggtcaaatggagttcctttcatatttgcccaggaagcttatttttctaaagattatggaaataacagatgtggaacaagcaagcactgcatgtctttcattcagagttctctgaggaaccaccttgggtaggcttttgtttgtcacacacatagcaagtatgtctttaccctgactgatgcaatagtccagcctcctgtggggtatcatccactaacaataatgccataacccattagttgattgcaaactctctgaatccatagggacttgccccagtccaaatgagtgactaattcttaaactacaaggtaaagctgaggtcctaagggaggagggacatgttaaggtttgactgtttattttgcttgttattactgcaggatcattaaagaaatgtttatatcctgttggggttctatgttcttaaccactatataaggatgaataagctttgttttttttgcttctacctctcttatatttctttccattctctaccctccctctcctaaggaaaaatggtgttcacactcattgggtctaaataaacccaaacgtcttttctttgaatattttattaccttatctgtttatctattaatgagaaattatacaaatgcatatttgaagttcttagtaaaagcccaaggacttaaacgcagctctggaaacacctgtcatctatcttttatttagtaaatctccctttgtcccagattcctcatttggaaaatatgtcatgaatttgttatgttggtatcataaaagatgtaattgtacaagagatagtaaagtatcacatgttcatttagaatgatcacacataaatatgtgcttttttctctcaaccgtgacctgtaactatccttttttgaatgtcacaaaaatctcatgtctataagcctctccacactgatgagattgaggcctaaaaccatcatctcccagctctgtcacaatttccagatttgtctctgtctttaggtttgctcacttttgagcacatagaattatgccatccttttcaaattacatgtcagctccttactttatcctacccccagtagtgagcgccttagttgccttgcttcatcttttgatgtgtttttacactgtttgtcatgccagcatttcttgtgagcaccctccccaagacacatacacacacacacacacacacacacacacacacacacacacacacacaccacattcttaacctatggacatttgctgctgtaaattcattatatatggtgcattgaaaatgtttgctctgtgtttctttctggaccttgtgctagcaactttgttttgtcatttttgtcaagtgattttcttttttcttttttttttccaaatcagctaagtcactgataagattgatgagtatgagagattgatcattttacaatttccatcctgcggccatatgagaggttgtatttggtacctagattagatcaaagagtgtcagaactcaatgggctgtataacatgtggcaggtagcagagtaaattggaaagaataagaataccagaaggagccaagaaatacctgttggaaaccccaatctgccctaactaactttgggcctttgagaacaagttactttatctctctggatatcagttttctatcttgtattagtttcctgtggctgctgtaacaaattaccacaaacttggtggcctaaaacaaaggaaatgtattttctcacagttccagaagccagaagtccaaaatcagtttcactgggctgaaatgaaggtgtcagtaggaccttgctccccacaaagactccaggggacaatctgtttcttatctcttctagcatctggtggctgctggcattctttggtttgtgactgtatcactccagtctttgcctttggggtcacattgccttcttttgcgtgtgtgtcaaatctcctcctccttcactcttatatgcatatgtgtgattgtattttgggaccacctggataatctgagataatctccccatctcagaacctttaagcatgtctgggaagtccttttttttccctaagaggtaacattcacaagttctagggataaggatgtgggtatcttttgggaggttgttattcagctactaaacgcctgaaataatatctgaagtcatgctggcttggcttgtaattgctattcatttcattcatttgttcattcaccaaacttttatttcatgcctaatatgtgccagacactgttctaggcaataggaataacccactgatcatgcctttagtaaattcattatattgttggtgagattaccatacagaataaatgctaaaataaaggtaaaagagacaatttagactattggattaattctttgtatgtctccttttgcacagttctggagcacaagccaccagcatgcctcagtacttgtaaatcatttcagtaactacaaggattatgtgtagtgtagcctgtggaccagaaagtattttacagaggtcaaagcacgcatcagcttaaattcaattcaggtgtatatattgagtacaaaaataaagtttagacctccaccacaattatacaatttttgtcaaccctggctgcacatcagcatcaatagcaggcctttacaaactactcatacctgtccccctaccccaccttgtgcttggttctaggtggagcccaggggtcctttaaaaaaatcttattagcagattcttacatgctgagggcattgaacagagagaacctgtggtctgaagaataggaaaaccaaatacaagggtactgatacaaatgcaagtcaaaatactgtaagttttctcaggatatatagaaacaaaatagtttggatactcagaggaaaatgagatcacatctggctcaagggaaatttgaagacggaagtgtttgaaatatccttgatggatgtgtaaaatttcaacaggcattgattaggggagggtggaggaaagggaatccacagaggtctggagtaggggaaaaggtgtgtgtcatggctggcagcagggcccaggagccaagatctaggcaccaattctctctccttttgctgagactttctggcctggaaacttgaagagcttgagaattctaaatttaaatctggtcctctaggtcattgtgaaggtatattttttcaaggcaggagggtaaaatgtattttatttgacaggtaataggttgatatatactttttaaaaatttagaaacatgatttctgggcttccatttgtactcttgctctatgtcgtacaagtattaggagcaggcttctgtgggggaaataaaaatggagaggaatgttttaaagtgtttcaaaagaagaatagccaatatgtgatgactgacgggaaaacagacaaacatagtgggaggtaacaaaggtaatttaaaagttcaagaatgacagtagaattagtgggagtgagacatattgatggaaaagatagctagcatttgttgagtttttctcacaagccaggggctttcactgcattttctttatgtcaatgaattattttcataagccttgaggtaggtactattcttatcccattttacagacgggaaattgagactttgaggggttagttatcttgctctatcaaggtcttacagtaaatctagctcttggatccaggtaccttaattccagagtttgtattgttaaccacagttctgctagttgtcaggagattggcttgagaataaggctgatgaagagtagttgaattcaaagacaggaatttaagaatcatcagaagagaggtcacagtcaaaaacttgggtagtcagcaagcatcaccttatcaattaaaaaacggaagaaagagagaagagtagagggacaagactaaatgtcactgaagctttcagggcagtatcttatacctgtttatggctgccagtcacttaacatatgattttttttttttttttgagacggagtctcactctgttgcccgtgctggagtgcagtggcgcaatctcggctcactgcaagctccgcctcctgggttcacgccattctcctgcctcagcttcccgagtagctgggactacaggtgcctgccaccacacccggctaattttttgtatttttagtagagacggggtttcaccgtgttagccaggatggtcttgatcttctgacctcgtgatccgcccgcctcggcctcccaaagtgctgggattacaggcgtgagccacggcgcccagccatggtttgtttttttaaaaaaagcccttgaatatttaagtaagcaaatgaaccaatccctcaatcgtgaatttttctacctgtgcttcagattctacatacataataattacgatggctagaaggagacaaatctaaagaatttcctcaacttttgctgcctgtttttgtgaccctgattcagtttcaaatccttggggatcttccttggattccattttttcaccttactccatcttttcccccacagaagatagctgcttttggaaggttatcctagcataagaagattggcagaacacttcactacttttgtcattttaaacagtttctttaatttaaatttttcatttttctgtagagatgggggtctcgctatgttgcctaggctgatctcaaaatcttggcctcaagagatcctcctgctttggcctcccaaagtgttgtgattacagacatgggccatcacacctggccattttaaacagtttgtaaactaaggtattaaagtaacaatacataaatggtaaagtatcctgggctgttgagtgtctttctcctcccctcctcttcgagtgccctgaaacttttttcattctaccattctcacaatgagtatgcataaaaagtcactattaaataatccaggaaaataaaactattgcctttaaaatatataaattatacatttttttgttacctgttattgcatgttgagtattcctcatctgacatgcttgggaccagaagtttttagattttgtatttgtttggattttggaatatttgcatataaataatgagctattggccgggcgcggcagctcatgcctgtaatcctagcactttgggaggctgaggcaggcagatcacctgaggttgggtgttcgagacccgcctgaccaacatggagaaaccccgtctctactaaaaatacgaagttagctgagcgttgcggcacatgcctgtaattccagctctacttgggaggctgaggcaggagaattgcttgaacccaggagggtgaggttgcggtgagccaagatctctccatagcactccagcatgggcaacaagagtgaaactccatctcaaataaataaaaaaataaataatgagctatcttggggatgagacccaagtctaaacatgaaattaatttatgtttcatacataccatatgcaaatagcctgaaggtaattttattcaatattttaaataattttgtgcacgaaacaaaatttgtatacctgaggtaaggtgaggaatttccacgtgtggcatcatgttggtgttcaaaaagtttcagattttggaatattttggatttcagattttcaaaataggtatattcaacttatattaaccagatcaaatgttctatgcttgtcttgttctcttgaccctcggattatttcacaatcagaatccagcatattcatttgaaaggtgtagggtattgaataaaaaggatttcagaacagctatatagttgtgtcagatattttaatattatagtactgtatttttgtgctattgtatcagagtcacatttttattaaaatttatgatttacacctaatctcttaaaaaatactgcagagcttgccttagtctgtatcctgcatgtcctatttctttttctagtactgtaattgagttgctatgtaaaatgtggtctgcctatgtaattcttcccacctaactttattaggaaaattaatagaatagcaatatcacaaaagtgtttgattagaatcatgggaaatgaaactaatttgcaataaagcccaagactggctttcaaagcaagtgatttttatggttagaagtcaaacaactttacttacagacagtgatcgaggcaaaaaaagtccatttgttatttgaaagacatcaggaaagccactgattctcagtttggactatacattaaaataacctggagaactaaaaatgaaaaccaaaagtctgaaccaggaccaccacctcaatgatactgacttaatttgacttttatgaggcttaggcgtgagtattcgttaaacctccaaggtaattataatgtgcaactaatgttgaggactgctattaaagcaagcatcaggaaagcacaaagaacaggataaagtaaataaatataaaatccttaccatttaggagatgacatgtcctttctaaaagaggaaatattgtctattaagttatgaaaactaaacttttagttctattttgaaaagagacaaattaatctcatttaaatattgttacaagcatagataagagtacatatctatactttttaaaaagccccttttttttctctttgtatttaaactcacttatcttcttatattcaagattattaaatctcagctatgggcctcgttttcccctaccttcatattgttccaacttatgaattgaaactgtacattaatttccaaatgaataatttaaaatcaatggagtaaatgggacacttgcagtcaatgaaaaaatccagcgattatctcgggcattttttttctccataaagaaagcatgattactcttacaaaatggtattttgtcacttcgtgcaaagtatcttgatcattctgggcctatgttgctttttctgtaaaactgggatatcacatattgctgaattgcagtgaccatttattgagtgttcattgtatttcaggttctaagtgtattaagtactttatatgtgatatctcattttatcagattgaaaacactatggagtaaggactattttctaaaatcctattttgaagatggaaaaccaagccttagagacttgcctagctaggttaacatgtctaaagttatatttcttgttatcgactgggccaggatctgaatttaggcagtccaacacggtagccactggtaacaaggtagcgctaaccctctgtgaagacaaatttttctgtttagctgactggttaagactaaaattaaagcttgtaccttctttacagggacgttttccaaaaagacagtcttgatatttcccaactgagcaacaggtttttctgttgaagctaacaaggaacaggtgcactgctggtgttggcatgtgccgctggcaccggacttgtggtaggatggtgctttctggtgctggttgggttttaaggaaggagcatgacactcaaaaattcccaaagcccataagactctgccccactcttcactaccaaatcttagggaaaacttcgggtagggagaaaatagaagagagctcttctggattaacatgaagtggcttgaggaatgtcaggagtgggaagccaggaaaatttgtggtcagaagaccttaattaaattcctggctctgctcttcatgccctgaaagtcactcaacttttctgaatctcagttttctcaactttaaaatagaaatgatgatgtggtaattgaattccatacttcaaaggacagatgatcaaataagataatgtactgtaaaaactctaaataaagcataaggtggttttgaaaactgttaatgttaataaaagcagatttttattttctaattggaagtctttatctctttaacatgcagaataaaagtaaaacaatatttactctacagaactacttaaattagaatgcctgtgtggtatacttggactgacttttacttccccaaagtgttcaaaacccctaggcatttaagcaactttcagtgtattagttactgcctaatgggcaaaccctatgatcttttctcagtcttcatagaattatagcagtaataatttattattcaataagtgtacattgagtacctactatgtccctggaatgggtttaagtcattggaaataacagtcagtgaaaataaaggcgggcaaaaatgaaattgtctattaagcacctaatgtggacaaagtgttacatataatctcattgaatcttcacagcaatcctgtgacataggttttactggcattacttataaatgaggatactgagggtcagagagtttaagaggcatgtctggcacatcctagcaaggagaaaagtagaactgggattaaaaccctattctatcttcttttctagcaagtggcttttcttgtgaccatttatttgttaattcatttattcatacttcactcagtagtcgtttgactttcttctttctatgaacatcacagatattttcttagccacctgtggttaaaaccatggcaccatctttaaaactcttaactctattcccctccacatcaaatctgttccaatcttgacaaaccttgtcttccatttttgttgccaaccttttgcacttattactccttgctgctactattctactagacttagaactagtctactttccctctcccctccattcagcctaatccatacagtgttgcctagtgaatcttactaaagcacaaatctaattatgtaatttctcgaaaatcttccatggcttgccatggcctacagaaattgtcagtaatcacaaggcattcctactgtcaagggtatagggcaaaccatattttcagccttcttcagtgtgcttcttcctgtgcacaaaattcatgtttcccaggcttgtctgataagaatcacctggggctaaaataattcatagattcagtggtattcccatcaaaataccattgacattcttcacagaattagaaaaaactattttaaatttcatatggaatcaaagaagaccctgtgcagccaagacaatcttaagcaaaaagaacaaagctggaggcatcatgctacctgatttcaaactatactacaagtctacagtaaccaaaacagcatggtactggtaccaagacagacatatagaccaatggagcagaacagaggcctcagaaatagcaccacacatctacaaccatctgatctttgacaaaactgacaaaaacaagcaatgaggaaaggatttcctgttaaataaatggcgttgggaaaactggctagctatatgcagaaaattgaaactggaccccttccttacaccttatacaaaaattaattcaagatggattaaagacttaaatgtaaaacctcacaccataaaaaccctagaagaaaacctaggcagtttcattcaggacgtaggcatgagcaaagacttcatgacaaaaacgccaaaagcaattgcaacaaaagccaaaattgacaaatgggatctaattaaactaaagagcttctgcacagcaaaagaaactatcagagtgaacaggcaacttacagaatgggagaaaatttttgcaatctacccatctgacaaaggtctaatatccagaatttacagggaacttaaacatatttacaagaaaaagacaaccctatcaaaaagtgggcaaaggatatgaacagacgcttctcaaaagaagacgtttacatagccagcgaacatgtgaaaaaatctcaacatcactgatcatcagagaaatgcaaatcaaaaccacaatgagatactatctcatgccagttagaatggcgattattaaaaagtcaggaaacaataagatgctggcgaggctttggagaaataggaatgcttttacactgttggtggggatgaaaattagttcaaccattgtggaagacagtatggcaattcctcaaggatctagaatcagaaataccatttgacccagcaatcccattactgggtatatgcccaaaggaatataaatcattctgctataaagacaaatgtacatgtatgtttattgcagcactatttacaatagcaaagacatggaaccaacccaaatgcccatcaatgatagactggctaaagaaaatgtggtacatatacaccatggaatactgtgcatccataaaaaggaatgagatcatgtcctttgcagggacacggatgaagctggaagccatcatcctcagcaaactaacacaggaacagaaaaccaaacaccgcatgttctcactcgtaagcaggagttgaacattgagaacacatcacacagagaggggaacaacacactccagggcctgttgaggggtggggggtgaggggagggaatttagaggacaggtcaataggtgcagcaaaccaccatggcacatatatacctatgtgacaaacctgcacattctgtacatgtatcctgtttttgtttgtttgtttgtttgttttagaagaaataaagaaaaaaaagaatcacgtggggcttattagtatgtgagttcccagaccccacttgaccatactgagccagaatctgcaaggatttacagagccttgtggggcatggtaagactggtgttcctcccaaagacccagaacacaggtgcatgcctgtgattatcctaggtctcttgctagcactgtgtgttgaggtagtcagccagtgtcatctgatgtgatgacactttgtcatatctgagacctcccagtcaccctttctcacgcattactgaggtgcaaaccaagtgtcaaaaaacccaaagacacattaattaaattgaatcctccaaagaagtgtttttctcacatttttaagagcatgagatatttttatgtgagcacaatgtgaaacacataaaaagatttaacttgtaaataacttgtgtgtggtgtgtgtgtgtgtgtgtgtgtgtgtgtgtacgtttgagacagagttttgctcttgttgcccaggctggagtacagtggcacgatctcagctcactgcaacctctgcctcccgggttcaagcaattcttctgcctcaacctcccaactagctgggattacaggtgcctgccaccatgcctggcaaattattttttgtatttttagtagagatggggtttcaccatgttggccaggctggtctcaaaactcctgacctcagttgtcccaccaatcttaccctcgcaaagtgctgggattacaggcgtgagccaccacgcccggccataaataacttgtttagctcatatgtgattgtccaattttgggcatgtatacatagatacatatacatatataaatgtatataaataaatatgtgtatatgtgtacataaatgattatgggcatatgtatttgtgtgtttgaatatatgtgcttagggatagggacacacatgtacatgcatagatgacttgccttcgccaaaatttatacagatgtttctcaacttacaatggggctatatcctgataaacccattataagtcaaaaaattgtaattataaactggcttataaaaagaccacccaatattgcaagataaaaggcattaactgtaagattatgatgcaagaggaaaataatgaccagaaaataagttggagtggaaaacgtttctctaaaactttctacgctatcattgaaatagctattaaataatatattgaaataaagattgttgcttttctctttttattttcccaattttcactcttattaagtaaaattactcagcttttaaaatcacttgtatcatctcactgtgtatttacagattttttgcttctcagaaatttctgtatgtcccaaattccttttaaatatttaaatattatgcatgttttacctttgtaaactcctacctttgtaaaacatgcggaatattatttatctcatggatttcacccactgtcaaaagtctacttccctatcaccaataaatacttgaatactattaagtgataattttttagaatcacagggatcaaactatagttgacttttgaacaacacagggattaagggtgctatcaccacccccagtggaaaattcatgtgtaactttttgactccctgagaacttaaccattaataccctactgttgactggaagccttactgataacataaaccattgattaacacattattttatgttgtatgtattatatactgtattcttacaataaagtaagctatacaaaaaaattaagaaaatcataaggaaggaaagatatattgccatttattagctgtgtgggtgaagaaaagttacttaacttgactacgctcagtttattcattaaataatctttgcagacctggtaagcactggatgaaataatgtaataagacaaaaatgtgaagattttctccatagtcttatcactctgtatcataatttaatcatgtttctttacacggtttctcaattcctgagagaatgattttagacaaacccagagaactctctttgaatatcattctttgtttcaaatgtatttccttgtggcaggaaacgataaacacacatggcacagacagctagtgactgaaggggaagttaatggtgtttgtttttcctccagaattagtagttcagaaattaaaaataaaaatgtggcttgccaagtttgtaaactacacagaattctttgattacaagatgacaatgaatttaatttttttgacatttgtatttctttgatacttatgaattgaaatgttttgaaaacttatgaatttgcagctttacattttataaactataatgattaaaatatccaaatccattaatttcttccttgccctgtaaacttgaaaactgagaaaagatttagagtaaagcattttgaaatcattgacaagcacaaatactgttagattctatgtcaagattgtattgctgcccttgaggagacattatacgtgctttctaagctatgacgagaagacataaacaaggtctttccccagctatgtgctagaaaaaaacccttaattgtgattgtacagtattgcttgatgcaaaagtcaactcatttttcaccagggattcctgtccattcctggaaatgaggtaggatgaacccggccggggggcgggggggtgtcacagtagaaggtggtggtttaggaaaatctacaagtgacggtaaatactattctagaaagttaatttttttttatttcagggagcaaatcctttatatttggcaggtagaatgcaacttcttggtagtgtctttcatttaattaaaattaagattgatgtggcttgctgctgctgcgtaatatcattctgacttttgcatagctattgcatttgtaaatattcaaatgcactttgttatggataaaagggagttccttgggtagatgtttaacttttattgcaaaacctcttgtgctcacttacgttgccagatttggtagtagtcatgcaccctgggaaaatcactggcaaagcagtggagtggaaaggaatcatgggtatttactgtgaggagaagggaaggtaaaggtgttgtaggggttatatcatttcactcaggaatttgcttttggaaatgtcattaaggatatagtatttggggatggtaggtatttttagaatgtttctaagtaaaatcacgatttttcttttaatgcactgtgaagaaatcatctagtccagtgctcatgaaatcaatttagtaggttgcaattcaacaatggaatagaataggctaaaatacaacatgccagaatgcacacacgttgtaacatttagtgttaatttatgagactgcatgagttttatatagataagcatgtttctatatatatgtgcattgtatttaatatgtatttctcagtatgagtagctgttgaaaaagcttaaaagccactgattgactttttctcccattttacagatgaggaaactgaaagaggctgattctcattttatttgagtgggtctccttgaggcagcttatctgtcatcaggggtctcttgttataatctgtttaattacctatgcatcttttacaatttttcacccttgctcaaaaattgctatatttttgtgaccagaaattggatcaaagatgctgattctggggagataatctttgctgagtctctgagcaccatgttggatgggtagttggtgcttgtaataccaaggggaaaagaacagaatatttatagctctctgtagaggtaagatcttaggtaaagtcagatgaaaaggtggaacaataatctaatacatttcatcaatagatacaacaaatcaccattagcttctaccatttgtttcagttcagttcaacaaatatttattgagctcctacttagtatcaggtattttaaaagctagccacttacttccttctttatgataaattaattagtcaaacaattaaattattctctccctttgcttgtggtgtacagggagatttactgaagtaaaagggggtttcgtttgtcaaagatgaaagagatgtagcgccatgctatataacacaatatgctacttggaaatctgttatgccttatctagaaatgttcctaatatcttgaactccacctttcactcattaggaagtcctgcaatataaagctcacctataatattttctctatatttgctctcataacacattgatttatattgaactttctccttgttgctatttatacagtgtcagttctgctctatgagctgattttttttttctctgactacctgagaattgaggcagcagggccaagggggccgacttgccacgtgaggttttgtctttcccaccttgttaggctgcttctttgcctttctgcctggcaattcctgaaggtggtgttctgttttatctcttttttgtttttaaagtgtttgtgcaaagcatattattctgtttttactttgcttcttaattgagtatcggccatgtaacttattgtttgaagcagttacagcatcagggaatagtcccaaatggcacgatgagcctgatttttcctgatggctgtcactgtggaaagggacacccatgaggtcggtccaagccaaagaaaggagatgtataagtacagcctaatcttattagtgggtctagaaaaactgcttctttattaactgtcagtcttttaaatctttgctaattataacgattaaacatgatattttgtagtcatttctacttgcattcttgattattagtagttttgagcttttttacatatctctgtaggattttcttcccatgtttggaatttctgtttgtgtcctttggttatttttcttttagactattctgttttgttattgatttataagaccttttttctatcctattgaaattaatcattttcattgtggttaaattttatcattttaacatattttgagtgtgcactttagtggcattaagtacattcacaccatttgccaccctcaccgttgtcccatctccagaaatttcccgttatcccaaactgaaaaaaaccatggtaggtgctatgaaaataggcccaagggcctcttcgattcttaacaagagagatgctaaccccttttttcccacaacactagtaacacttcttgaatcatctaatcccctaattatttctctggatccagtgctgccatgatgattgcaacttcattttaaagatgtattcatacattaaataaacaggcaaacagctgttctcatatgaccatcttattgagcaaattctgttttgtttagtctttatagttcttccacttgttatttaatctactggtgtttgatgttttccttgcttgccaatgtggtatttccagctgtgcatggaaattaattttctatttgaatagacaattccaggaaattatctattaaggttataggaggcaaagagaatgttgctttatagttttgtgtgtgtgtgtgtgtgtgtgtggtgttcttggcattataaggaggaaaggttggtttaagagttcatgattgccagtttttgtttttaactaatattacttaaataaaacaaactctgccactggtcacaaacgctgtcaataataggaagtatggggaactgaaaacttattctctatctgaaacaacaattctaaatggattgctcatggactctgaaaccttttttggacaatagacctctttgtgtatctgacagattctgtggaacctcaaaacctaaggttcccatatttttatctaaaaccctagttgagatgcattttggagtcaagaatttatcagattttaaaaaggtagtatgatttaaaaaatgtattgggttttcaaaagtaccatatacccccatattacctatcacctttaatggggtctgggatggttccctataatcaaaaaatagtatttctgcagttaaattcatagatcttaatcttaaatgagataaataaaaacatgaaatagcctcacatctgtgtaggtcagtttatgctgccagataagttgaggtttgttgccaaacaatttctgaaaaatcttttgttctttaggatcagtgataagggacaaacacaatttcacctatactctagggggttccactgttcttggtcaggagtgttttggctccatgcttcagccgggcctgcttctcctcagccctactcaagtcatggacttagcattttcactgttacagacatttttgcttctggagttctgcacctgtcacttttttgatgaatttaatcctcttttttgcagccatatcgtatatgggctctcattctttatactcaatatgtttgccgttatgtataaatgtttcatcataacgtgaacacatatattatgttcatcatcatccctattcctttgtattggttaaaaaattggttattctcaatacttgaaatgccttttttctgtcttcctcctgttaatttatcctctaccccatcattgtaccaggataaccgattttctccttcttttatattctctatattcttttaaagctttgtgtctaccactgttttagcatgcattacattcctccataattatttgaatatttatccatctcttatataagactgcacatttcttgagagtaatacctctttatatatccattgccttgcacagtgcctggcacatacagattcaaagcttttcagcccaagataaatagaaggtgtacatttggagccagtggggtaagattggagacatgagaaagagggatgtacaatcttaataaattagagttcaagacagaatagtgtagaggaacagtgattttgtttagtttatgtgcacatgaggattaggaaattaaatgatatatatggtttggagaatggagaaatttcaaaaaggaggtaaagcttcagacaaacctgggcaaatggatgagattgggatggaataggcaaagaagaatgtacagtgctttcagagaagggagtatgttgaggagcgaattggcattggtggctgaacaagatatttaagctattgccaaactataatggaagttctgaattatgagatgatggaagaaaaaggtcagtaggccaaatggtgctggattatgtaaagcaatatataataagaaaaagaattcgatctattcagagtaaggtgtcattataagttaaggagtagaacagggatggtaagataaaaaacatttctgaaaataaatgtgtccacagcgtacgcagtgatgcctgaactaaaaagggtgtaggggtgtggggctgagttgttttacatcataaggacctgaaccgagaagacagtaatgagactggagaaaagggtgtgaaacttttgaaaagtaaaaccatagtgtgatagttaatttcttgtgtcaactggagtgggctacaggttgcccagatacttggtcaaacactacttagggtgatactgtgagggtgattttagatgaggctgacatttaaatcagtagactgagtagagcagattgccccctttaatggggatgggcctcatgcaattggttgaaggcctgagtagagcaaaaggctgaccccccttatgtaagagagaattctcttgcctgacagtctttaaactgggacattgaccattactggttctgcagtagccttctggcttctgactcaaaactgggaaatcagctctgcagcttttggacttgccagaccccttaatcatgtgagccaattccttataatcagtctccctttctttctctctttctctggagaaccctgactaatacgcgtagtatatggagactgactagatatgggagccacaggagttgagaaaggaattaacaattacttaggaatgggaatggagaaattgaaaagggcagtcaattttgatggaaaatatatttggttttgattttgttgactctgaagtgatattggagattcaagttaaattactgtaagcagctgtagtgaggtaggtagcttgtgtgggtgaggctggatgttgcatctttgaatcatctacaagtagggcaaaagaagttacgtgacagaacagagttcacaggtgaatgagagagacaagcataggcaaggatttgactgaggttcttcaggtgggaattatggggctagaggagaaagatgagccagtgtataaaaatattggtggcagagctctcttgacattggtttgtcagcctcttgcaccagaatgtaagctccatgaggccaacaatttactcagtcctttttccctagctttaagtgttgtacttcagatatttgagatttgtagacattgttttttcttcattttccacttgagacaaagccttttaaggaaaactgaaccaggaattaggatttatttgctgtaatcttgactttgcacttagatatagagactgaggtttgactttttaattcctaggattttgactcctttttcaaaaaatgaggagattggattaagaatttgtaggattccttacaactcaaaagttatggagaaaaatatctataggctgaaaattgttctaagctgcaaaaatggccttgagtaacttcagaaaataaacattaaagcaaatcatcttttatatcccttttttgaatgttttatttatttaatatcaatcaaaatactgtaatagattaaataaatcaaaacacatataatcttgtctagaagcagctttggactaaaaattttcttcgcaaaatattaaaggtgtgacttttaaagaaaatctcttaatacaggacctaaccccattttatatagcattaagttaatataactgtaaaaaagaaaaaaatataagcagcatttttcttttaatatcaacaccatagagaaattttggttcttatggaaattttattctattacaaatcttccaactgtaaaatcttctcttagagttgattatgtaattgaaaacaaagggaagaatcagtggctcaaatggtcctgtgtttaccatacttcattcaaaattctcttgcatctcctcatatgtttctagatatgttaacatcatacaatctcacaatatccatttttaatttatgcaagaatactttctgttttgaatagcacattattctaggttatatccaatgtcagttttgggtatttgatcaatatgtgatggttaaattatagatggctaactttttttcctaattgtacaatttgaaatatggtgaatttccaaaaaatagtttggagaaaatatgaactctattttaaaaatgtgcatgtatgttgatatcatgtatttgacatagaaactgtcaaacagaaatagatgtcataaactttaattcaaaggcattagactactagcactaacaaccaacattttttttttatcaaatagaacttattttgcccccaggatcatgcgttgttttagatattaattaacattataattgtcttctcactttctggtatgcaggggtactctccatgaccaatctttgtcatttatcacctatagtgtaaaatttccatcaggaaacaatcttctgccttgaactaccaaagtgctgattttgctttttgtcattaagttttttgtttgtttgtttgtttgttttaatttgctttagagcttctttattgaggacaactaacagttaagagttttcttggggaatagtgtcacagcaagaatcacacatagacttttcagatacaattcttctatctccaaagtaatgctagaaatattgttgatttacaatagatataatttaaaattatttatttttattttccacagatcccaatttctggatttcttgtgaagtttaataatttatccttggattcattttatttttgtttatatttatatagaaggcatttagccattcatgttgatcagctgacctcttagttccatttgtataatgtaatatctggttatataaacccaaggatctgctgttattgtttgctctgcaatctgatagataagagattaaaatagggtgggtgtagtggctcatgcctgtaatcctaatgctttggtaggccaaggcagaaggattgtttgaggccaggagtttgcgaccagcctgggcaacatagtgcgacctgtctttacaagacataaaaaaattagttgggcgtggtggcatgctgaagtcccaacactctgggaggctgaggcaggagggctgcttgaggtcatggtttcaagaccagcctggacaacatagtgaagtcatgtgtctaccaaaaaaaaaaaaaaaaaaaaaaaaaggctgtgcttagtgttgcacatctgtagtcctaccacgcaggaggctgagatgggagcgaggattgctggagcccaggaatttgaggctgcagtgagctatgatcacaccactgccctccagcttgggggacagagtaagaccttgtctctgaaacaaaaaacagagagagaaaaaaaataataagatgtatgtattcagaaacataaaaaagcaagagtaaaacttttgtgacaactttgttccatttataagtcacactaatgactgatttgcttcttagtaattttccatttgtaacattttgtacctggatacacaaatgtaatgcaattgaacaagaaaacaattatctgtctgctggaaataatgtacttatctcattgaaacaattgacttgtttaaaaatacacaggtctgttcagactgcagttacctgtaatttgtaatgaatttccaggaagaattaaaatcctctgatgtaattgaatcagtagttgaaaacactgattgtgaatgataaatttccatgcataattcccctcttatataaacctccatttggagccattttagatttgagaggttttttcaatattctatgagttttggctggatccctggaaaacttcactcaaaggctgtatcttccagtgaaagcttcatgttgacttgtgggttctgtgtcagtggaacgtttcagtactttttggcctggctcaaatgtttcttggcattttctgtggagtttggcccaaccaatctatagtatcacattggactccagataaaccctaaaagccgtaattcatccgcaagctaatatgggactttattggggtttggtagtagactaacaccatcgagcaattgggagttcaacattatgaatgatatttctaaggacatatctatctgaaaaatcatacaaagagaagctacttttcctttagcccagcacttatttttctcagaggtctctttcacagaggtcaatgtcctattttaattcgttattataattttttccctcctcagcagtttctaaacctattgcagatcaacagctttttcttctttcttaaagtgagatggctctggctcttggctgacttcagtcttgtgatgtgggactgatgtgcgttttcatttttcactttgaaggtgctgccaaagctagttaattttagttataccatcatagaatgctggagcctgtaggtgccctagaaatggtttggtacagcctcctcgttttacacataaggggagccaggcccagttccttagttctcacaggaagctacggcactgttaggatggaactcgtgtccgcctcgcaacagaacgggtctctgcaagtctatccggctgctgaaagatccactccccattcccagtctcagattttgtacctctgggtagttttcctcttttccttaaagctttttaaatgtagctccccatatgttatattaatttgggaaaccagccaacaaattagttttacatttgttaggattctagggtgttatttatgataccattctctttgtgttctgagtcactaagaaataaatataggaacaagacagagatcaaaataatagcttcattataaacagtgttaaattttagaacacatagtggacccaaggtggaagccagcttcttatgcctttaacagtcccctactgagcttagccactcagtcatagagaagtgtgcaactgcaggttcctggtccagccctcatctgcagggcccaccctcagggaggactagctgagcagcacctctgagagactccaggaaccaagggcctcctgccaagggaagggcctctttctcaagtctggccaagtagagcagtccatacccactcatggaaagcagtgtccttcaatggctcaccttctggtgagtgtttctctttccttcttttctcttgctttagcattcctgtttcacactggtattctgaaaccaatattagtatatttcttttccttgtaagatgagttattttcccattattctcctgaatagagttgaaaaagcaaaggtagcaaaatcagcctaggcaactgattatttacaatagagaaaaataaatgaagaattaagtagccggtaatgagagatggcaccatgggaacgtgctcagaatacttcccagtaatggaagatgaataatttttcctgttctctcctgaccaggccattgttctcacatttttaagaagagaaagttgggaaagacttttacctctctgtttacatctttgtttaagctctagacctctgccagcacccaccattgtattttgataaatatattctcagccatctataggtggattcacatgatcttgttttgctttcattttcctgtgattttgaattaagtaaaatttcagatcacagaactctcttggaaattttagttgattcatgtaggtaggtttctataggtttcactatttcattttgttccagatatttttccaatgtttatctctttttttaaatcttctacattagctttcaagatacttacttatgagagcccagataatatttaagttttcttcatattaagggatttttttttccttcagatttcttgccttgtggtgcatgttgcacagacacttgtacttaattcagaggtaaatgaaaagtaatttacaattctaatactcttgatactcatactttctcctttactgtttttatgcttgcaggtttcacttccttttagtaggttgagggccatttagataaaaaagatacagaattgcagactagtagatttaagagtttatgtattatgatttaagttgttaagatttaaggtgttccagtagcatacttggagttgaaatcatgattattaagatgaattctttttgcgtgagcagcttaacagacttctcttgaatcaccataatgtttttgcttcatgggcatgtcaagtatctgttatagtggaacctgagagaggtcatacaggaaatagcatagaagttgtcacagtacacctggaatgatgctcaagtggttgccatgggctcaggagccatttgcctgggttgaaactcagctcttcattcctttgtttcagtttgctcatctgcacaatgggcatactaattaagatatctacctcgaaagttcttgtgaggattaaatggatgaatatatgtaaagcagtttaaacgagtgtctgaacattatatatgctttataaatgtgagctgttaaaacagtccccacgtgcctaattgggtgaatagatcagggttcctctgtgttttcaagtgtttctctcagtacactattatttaggaaaaatagactaaaaagatattgtctgaggtgttactggctgatattttaaaaggtgaaccatgcattaaaagattgtgagtctaaattttgtgtaatttaatattaataaataacctgacttctttgatggtctacgtgaaatatgaggatttcaggcactttgtttccacagccaaaccgtgtatgttgtcttcattactggcaccgattttggcattttgatttttaaattattttgtgcagttttcacagttgctcccattagaggggaagtattgaggaagtagtcttccagttattgacagatcttaagaagcataaaatggtttggtattttggagaaatgtaggataatataagacccagaggcatactattccaagtagaaaatttcatcatataatgcatttatatgtatgtggtatatgtgggtaggcaaattccatcatgaaaggaataatgaaggaacagttttggggcaacctaaagttttactttagtttgtataataattaactcagctgcataaatgccaggaaaataattagaacaacagattatgttgaatgcctaaaaaaatgtgtttaacaacttttaattttctttcctcccacacaccacttcctagtttgtttctggcacaccagttgtgtctcaacacagcggctgatctggtagagttgtgtgaacacctgtgattgtggcagaacaaattttctccttctggttacatttatcgaaagtaaaagtagaaggagcactgtattttggaggtaatgtagagatataggggatagcctaccttttctccaaagctatgtatgagctttcaatgttttgaaagctcatgcatactgaagcgtgtgtccacatggtgaatgtaaacaaacaaaagctgattgtaaccatcttgcttttcctagttagatatcaatgggctactattggtcagagaaacaaagagggacctccattagtggggaaaggtaaaaaaaatttagtgacagtgaaagttttaaaaataatatatattttttctgtttaagatattccattatatttatgacgttatgagattccttcaggagtggttgtttgataatctgtagtttacttaatcattcctatggtgttacagacagatttataaagttttgctattacaaattatggcaccacaaatacctatttgaatctgccttttttttttttttttttggaattatttactcagtttaaaatttctggcctgatgttattaggttaaaggctttgcatatctttgtaagtcaaaggatgtagattttaacaaatggcttttcaagtgctttgccaaattgctttctaatataaatatataaattgttaacaataatgtatgggtttttcagtttcactttttgagaccctgaacagtgatcgttgttgcttttttaaaataattttttgtatttattcaataaatataaagtggaacttcagtgttgtttcagtttgcattgctttggtaaataaaatgcgtgtgtgttctttttttcttcatgtgtctttaataatttaatttcctgttgtgcatgttcatgtttttgaggtatttttcttcttgattttctgtttttctgtcagattgtttatcccctgtatgtaacatacaaatcaacattttatcttatgtttgataaacatatttctgcaatatgttgtttttttattttaccatgactattacttttcttagtgttaaagctcaaactgttgtaaaagttatattattttgtttcttttattgactctaggtttaaaaagttgtcatctttcaaaaaaatattcaattctattttatgctaatgtttagtgaactaatttatatgtgtgtgtgtgtgtttataaacccacggatacatatatgcacaaatacacatagggagttagagacattagtattataatgatagtatatggcatacattttgatccatttttttcctcaaattactagccagttatgtcagcctcattgattacatagctttctgtcttctcctccccagttgttttaaatttcccctttatcatattattacattctaacatataattagatattttactgggctttatttttttattcactgatctatttcaaattagatataaaaatatttttaaaatttaattcttcaaattattaatgcttgataatatgctttaaatgtagtaggttcaggtcttcttttccaaaaacattgagcttctcctgtgttacaaactgtgaatatggaaattaaaattatacggtttccccactcatagtaatcaaagtcttgctggaaaaacagacatgtaaaaatgtaattatactataatgctacaaatccagaatggagagatgaacaaagcactgatagcaccgaggtgacagtatatttttacctttttcccctatattttctagttctaatgaaagtttgattatgatctaaattgctaatttattatatctacaaaataacttagaaaaatttgattttttaaaatcctataatcttctccctcagggttattgtctgtttcatctttttaattttctaattaaattctgtagttttccttaatgttaaatactggttagaaacatttcatgttaaacatacgcatcttatggatattatttgtgacagtctacaggtaattcagtgtttgatttatttctttaaagaagcctatattttgggtttaccattcacagggaaaatcggagcccatacttttttatctttctttattgagtgtggggtctcaaacattcattggtaatacctttgggatttggtaagaaatactgcacacagatacaatgtagaaatttcattgagatttttttaatagtaacttttaatagttaaaattttgaatagttgcttttgaaatgaatgataggccaatgaaaaatttgtgtgccatgaaagctatatttttatgaaaacctgattggaattatggaaaacaatctgtgttttatagtcatggaaacctgtgactgatgatcatttttggaatgttaattgtaatttctatcattgcagctgttaattggtaacaaggaggggattaaaggcattaaggagttttggaaaataaaacttaaacacacatcaaatagcaatcatttctggaattctgctcatattagttgtataaacctgactattaaaatatagaataaagtttatttcattattccagtttctaaactgtatattatttaaaaatatgtttgtatttacaaattaggtcaggagtaagcagggcctcagtgacgtaaataaatcccaatggaggcttgtctttggactttctcttttgtgtaattctttgtatatacaagatccttggccaagatcccattatacaaaagaaaaggtggggatgtgggggagggtgaatattcccagagaaattcagcctttcaattacttgattattcttgtggttgcaggaaattaaagaataataagtttgtttcctatgtgaatcataaaaaaataataagggtacacacagggccattgacttaaataaatggatggaccttaaaaaattcactttttggaggggtgcatcatgctttttgaggacacactgaaattttgttggtaatcccagttccaagcctttcaagttagtttaagtgtaggaagaggagtggcagcaactggataataaatttagtacaaatgtttattttatttcatttatgtattgcctcattcaaaaaatgattcgagatatcttttcttttttttttttttttgtcttttgaggcaggttctcacttggttgcccaggctggagtgcaatggtgccatattggctcacagcaacccctgcctcctaggttcaagtgattctccagccccagcctcccaagtagcttgggaattgtttttgtttgtttgtttggtttgtttttgtttttgtttttgtttgagatgagtttttgccatgttgcccagggtggtctcgaactcctgaactcaaagcaatctgcctgccttggcctcccagtgtgctgggattacaggcatgagccactgcaactggccctgatttgaaatatcttataagaacatgttcaacttaataataataaaatgtgtatagaagaaaaggtgcattatctggaaaagtataaataagaagaaagtcctaactggaaacaagaaaataaatattttaggatccatgcaattttgttttgattcattatttttatttatttatttttaataaagataggttctcactctatcatccaggatggagtgtagtggtgcaatcgtagctcacagcagccttgaactcctgggctcaagctgtcctctcacctcatctgcccaaggagtcttttttttttttttttttgatttgagctttctagcagccaaaacaaaaagagtgctgtggcataaaaggatagatatagatgccatgtcttttgccacacacgtgtgcatgcatacacacacacacacttacatactgtctctcataattatttatttattattagatttatttatttattcatttatttttgagaaggagttttgctcttgttgcccaggctggagtgcaatggcgcgatctcggctcaccacaacctccgcctcccgggttcaagcaattctcctgtctcagccttctgagtagctggggttacaggcatgagccaccacgcccggctaattttgtatttttggtagagatggggtttctccatgttggtcaggctggtcttgaactcccgatctcaggtgatctgcctgcctcggcctccgaaagtgctgggattacaggtgtgagccactgtgctcggcctatttatgttatttttaaaaagcaaattgctttcatgttccttaggagtggcacagctatgtggatctctaatttctaaaataaatttctcatacgtatgcttagtagtactttcgtttcaaagaactagcttacctgtgggtgatttcagaccaacctgttcagttcttctgtttgagagacaaattcaaatgcttatagttacccagatgaccacctttcacattttctatctcatcctagctaccacttctcccttaacatcacctgcaacaaacaaaatgactcccctaatctgaagccaattttaatttatgggatggacctagtcatttgtatccaaaatgtctgagagtatcttttttttttttttttttgagacagggtctctctttgtcatccaggctggagtacagtggcatgaacaaggctcaggcagcctccaactaactcctgggctcaagtgattctactacctcaggctccttagtagctaggactacaggttcgcaccaccacacctgactaatttttatattttttgtagagactggctttcgccatgttggccaggctggtctccaactcttggactcaagcaatccacctgcctctgcctccaaaagtgttgtgattacaggcctgagccactgcacccggcctgtaatatattttaaattgtaaacaaagttatcattgataagatatagaaaaaaatttaaaaaaaaattttatctagctgtcaatgagaaggaaagcaagctaaataatgaaaattaaattagcatgaggaaaatgaaaaataaagagagactggaagataccacataattatgtggctcataagtctaagagttttgaaataataattgagtcaggaaaagacttctgccttactcatatgtgcattttttgcatttaatattttattatatacaacttaattgtcccttagttaagtcctaatccactgaataaacaaaagtaattagtcaacataccttgcttagcagctttacctttttcaaattttattttgtttatttattatgtcatttccaaattcctgtgggccttttggtctgtaatctccataaaccactgtaggcatagacattttaatggaaagggctagtgacttttctggttttgtgaccttttacattctgattcaacaaaactttattggtcacccgcttatataacagtcactatgccaagagatttttcataccttatcacatattactttccataataaacccatgaggtaaatactttatggtccccatttaatataggacactgctaataagcctcagggagaaatgagcccagatcacattgctagtaagtgctaaattttggctcaaacccatcttgacgcttgaagccagtgttctttctatagccatatctcttgctaagtacttctgacttttacttaagatatagtcttctctttgattattaattactctggtgtgaactgtgatcttttatgaaatctaagactgctactattatccgggcaaaattgtggaattgaatcattgagatgctgattgaattgttgttgatggttcaacaattttgagatgagacagatcaaattttcctttattgaaatcagagtggttggagcttaataaaaaagcagaacatcttaaggtaaaagagcaggtacttttttctttttttttttgagacagagtctcactctgttgcccaggctggagtgcagtggtgtgatcttggctcactgtaagctccgcctcccagtttcacgccattctcctccctcagccttcagagtagctgggactacgggcgcccgccaccacgcctggctaattttttgtatttttagtagagatggggtttcaccatgttagccaggatggtctcgatctcctgacctcgtgatccgccctccttggcttcccaaagtgttgggattacaggcgtgagccaccgcgcccggccaagagaaggtacttttttttttttttaacactgacattagttctctttttgactgctaaggataactacaaatgatacattctgtaaaccttttgtctgaaataataaagaaagtgaagcacagtaggaattctttaaaatgttgtcttgttcattgggcatttattgggtacctagtataatccagatattctgtggtgttctgtgatacaaccttaaataagacaagacatagatctggctctcaaaatatttatagtctaagggggaaactttgaatttataattagattgttaattttcaaaaattaaaattcaataagttgcttattagcgtcatcggctttggaaatttaacacttttctaatgaagaacataagttccagttaagagggtttcctatttcagacaatgtagaataaatcagcttgttccataacttttaatatttttcaaatataactcgcattttacctttagaactaaagatatgtcgagaagagttcattataatgtaattgagtcacttaccaagcctattttaaaaccagttacttccttttcttactttgcactctgtgacacatagacttccagaatcagagaagtattgtttttgtttttaggcacttgctatattatgtggaaccaaagccaagttaatatggctaagtaattttcagttcaaggtaggatattagatagaaattctcttttctacttctagatttggacatgaagtagcttttcatgttataaaatgacaaattttatttatttgtaatgaaataatcccttttatttatagccaagttcatcattttaacacttaatcttccatgacagtccggaggagaagaaacttggcaaccattcattattatctgtttttatcatcagaaggtatttatttgtagggggagtgtagaaatgatgtcaagggtaggacatttttgtacaggacggcctttcctttggagtcatgatggtaaatatgaccacagttacttaaaatgcatgcaaatagttaccagtcaagatgtataaagttccctggaaactcagaagcatgtgattatagctgtggaatgagaatgcctaataataaaaggagaaaatgtcagttttggattagtgatttaggaatcccatcagtgactatctaatcagcagcatttcacccgttgttttacaaagctcttattgagctgtgcttccatacctttgggcttgtatgaagatctgctcatcatagaagcccacttacctatagtttcaacatgacaaatctgagcttaaacacaaattagaatatttaggccctgaggctatttcttggatttaaatatagcacatagtaggtgaactttgagcttgataatgctgtggtacagtgagagaaggccagtgtcaaggatatctgaattgatttgaccttttgtccttgcatgtgaaaatgacgtgcttctgtagaagtctatatactcatgacttccttctaaaatgattattgtacagtattctatggacatttgatttgattcttctcacaaaattatcgagacatccactagtgtctacttaattgatggcaaacaagaagaaaactgtaatctggagataactaggtaaaccacatattctacatctgtgcctggatagaatgacttttgtggttatgtatgcagcaaacacttttgagtgctggtcatttccctaagctctgagaatgcaaaagtgtgccgtgtccattgtgattattgtggtgaatacagagtgttgtgagagtaaataatgtggagggagtgagaaaagcctcctgtgaggacatttagctgagaaggaagggtaaggaggagacttaagagggcgtcagaagttctggagggaaggggagagtgggagtttgagggacaaatggccgtcatggtggagtgaacgaaggggaaagtcacctgggattaaggataaagagaattcttgagtaactaaaaaattgatttgttcacgttgctcagtgattctctgactgtgtttctttggggagaggcttataaaaattagaatgtccaagtcttcatagctatctaaatgttttctgcatgtttctgtccagcacctatgtctgacttcatcccaatttgatgattaggatgatgataaacaggatgatgaataatacaactatggagatttaaattagaagaaaaaatcttctttatctttttttattgtaagatttattaatacaaatctgtattgttattcagttctagaatgttctaatatgcttcttccatccaaagttatgattacttctttacctcatataatattattacattttcttacaataaaatacatttttaaaattcactattaaccctgtctgtgatgagacagcataatcttgtggttaatattagctcaggctctgtagccagaaaatacgggtgtgaattcttgttgcgtcatcaaagatacagatgtgagtcctggctgtatcattcactgactgtttacatttaatatgttatttagccttcaaaacctttgtttactcatctgtaaaatgggataataattgtaccagcctcctaggataggtaagatgttgcagtgaagtttcttgttacgatgtatttccttgattatttcataagacagaggaggcatcttttctgtgttcctcccttgagatactaaaatggccagggagcaggtaagttccaaagattaggtttcagactgtcatatacaacttgtagtccatctgtgcagctggagactaaaccaaagtgtcacataaaccttttcctaatcaaagtggttgttcatttattaatgtaaatgccctgtgccttggatgtgtgagtcctaaaaatacacttccagggataaaaatagatttctgggagttctgagatgctgcttaatcagaaccagctgcaagctgtctagaaaacgcaagttatatgagccagatggcttttgccctttttgctttagacagcatgtaatttggataactacagctacagtaatacattttgccagtcacagtgtttgataaacatgtttgttgagaacagccacttccaattagagacccagtaaaatgttaatttattttaataaattttccctctagggcaagacaaagaatacttttgacaggttacagaaatatctgttcatggaacagagtactgttcaaaagttattgtatgccagtgattaatttttcaatttggcatttagagaatgatgagcagtattcatgacctccccctccatttttctccttacaacctcatgtatatataagagaccaggatttttcatatttgaaattatgttgctttacgtgtagaaagatggtttagctaatttttaactttcttctacccatgtctaattactataaactctgataatagttactgaattattgcttgcttacagatgcttattaatgtggtagttcttgggatttttcttttatgatcgtattctttgagaagaaattttctctgttagtcttatgtagccatgactgattttcatcagctgaggactgcaaacgtagtcactgatattggctgaattctaattttattcagctcctattcagacaaaatagtaaagctaaatgtgtaagctattcacactgtaagacctaaactcagatacagcctacttttaggagatgtgaaactatcaattcttccattttcactggtggcaccacttcttggaaaagcgtatttaagccctggtttcccattacaggaattgaaatattctgtgctttatttcttgagacatgtctaccaggcatcatgtaacagactgtgaagtacctttgaaggatctcttgagtcataatttttccataattccagtccttccagctttgtaagtttagtaatcacccagcagttgtttttttccttccccagtttaagaggagagggtatttcatttccaggataagtgatattagaacataaacatcattataatagtagctacaggtttatttactcttaccaggaactatgctaatcactttatacattattgcatttaagcctcactacaacatagtattataaggtatatatttttattctgttttgcagataaggatgtcactattaatataacatttttatattaatagagtataattgttctagaattatcactagaatgatgattattcaacatcatacagaaagtattacagccagaatttgaagctactcttgtattaatggtgtgtctggctcaggatctttaattccacccattaagctatgaaaattggcatttgacctaactagggctgctttttcagaggtaaatgcatgcctctggccatcttcatatacttcaaggaatttacagtattgcttcttagcatttattttaagctcagattgtatgtgaaagagtctgatctctctcatcccaccttgttagatgaattataactgatgtgctttaaaaataattcatactgctggggaaaaaatctcactttgatgcttttccagtatatagttaagaattacactgatgggtagtaattgaagaaattggtaagcacttgtgtgatatgaaacagcataggaaacttatatataatatatgatagccattatatataagcttatatataatgtgtataacatttacaaaagcaaaataatacctttatgtttttatttaacaaagtgagataaattcattagtgaatgcagcagggcatacctgcaaattctgtcataggtagcaggaaataaagcaaagcattgtttataaaaagacctctttgttatggttctgtccactcaaagcaaactgatgggggcatggaaaagatcttattacttttgactattttggaagagcatactgttggtattattttcatttgcagctataaaatggtacttcttgaaagataccataaaataatagaacagtttatacttaagtactatggtatgataatgggcttatgctgtttgttagcaaagagttggtgttatttgttgtttcttggaaatgaaagggagaaacagataatattcctttctaataaatggattattctattctaccctattctattagacaattttatatccaaacaattactgaactctatttttcatatttcacagagttgtacgcaagatctagatttgaatatgaaatctgatacctccgtgggccagtcgaaaaaagcattttgatatcattagatgagagacattatagacatattagttctagagaaagtcccggtcctttctttatgtcaagagatttgtgttagaaagagccaacaaggcctatgcactcaattaatatacatcagttttctgttagcatgtaaggtcctatagttggtgttcaagaaaagaacatgatacatgaaaagtgatctttgccaaatgtatccatgtttatgctaatgtgggtaaattgttcctcttttaccatgtgaaggattggtagcttaatagtttgctttgcttaaatgattttatgtggcagtgttgaggatctgcagaagtgactgtgtccttgccctcaaagaacttttggcatttggcaccaaaagggggcactgctctcttgtgacataaaatgtagtccccgaatagtggggcttttgaaggttagtgactccaaaggaaatagtagatgaaaggaaaacgtatttacttcatctcatgggggtctttcttgccttggtcttcctgaagaaaagataagcattgggctgaaaatgtttgttatatacccttgggcaccattggcatattccaagctgtttttgtcaatcatataaatacatatttagacaatttctgaaacatttctcataaagaaagaagtcattcatctggtatatcatattcatatgcatgatggctttctagagttgtgtcatttcttcactatggcttctctcgtctcgcacctcttcagaaggcacccttcctttcttttttcagtaaataccacaattttatttttaggtgtatgcagcatgaaatgtatgtgtgtatgtgtgtgcctgcgtgtctgtgtgtgtgtgtgtgtgtgtgtgagagagagagagagagagacagagagagtttgagagatagaacagagagattgattaattggttgattgattagttggttagttggagcttttcccagaaagttttccaactgttcttattggcatatttgaaagtttaacaaaatctcattaaagttcatggatttcactgaaatctcttatttttattagataatcagtaatattataagtatacataatctgccatcccaatattttcaaattttagttctttttctatcgtattggtaagaatgttacagtttcttcctaatgttggtgataggcatctgtacatctggttttgttggaaacaactctgctaaatgtttaataaggtgctcattgtaagttaaagatagggaatctttattatattatagaactaccctggcctatgcacatgtattgagatgactgcatgttatttagcatgcagggataggttctgttttaacatattttgacctattgatgtcgtaacttcattagtagattacctagtattaaaccattctgggatttctgatgtaaacacaattggacatgttttattattatttaatatgctgttgggtttggaatgtatttcatctagcatttttgcctctatatttgtgatactgaatgatagttttctgttttgtcagctggttttcaggttttagtgtcagggttactaggcccatcacttatgattatacaagttgtacactgccacctataatattgtcatttgcatagttattatgacagttttacaaaggaggacagtaaagtatcttgaggaagggacttttttttaaaaccgtattgacttaccatatcaactagcagaatgtaacattctaaaacagatttttaaaaaattccatatttttccattccttcaatgtttaaaagaatccacgcaaaaaatcagtcaggtttatttgacaatagttgtttacttaaatttcttctagaactgttcatctctttagggtttatatattctactcagctgggatgatcttttaattttattgaactattaaaattcattctttaacaaccaactatacataatattctttataattcttttattcttttctgtgtttttcatcccccttttgttactttactattttatctttttcttgaatattaagatttgccttttgttttcctcttttttccttctccaaatacttttggctttatttactggaatgtaatattttagtatttgaaattaacaactgtttttatctttattattttttcctcttgctttccttagatatagtttgttcacttttttaaaaggtatttgcattgaatatttagctttcttattttctcttattttttattttcaaaggacctttttgggtacttttaaagtttgctaatttactgtaactggaacatttaatatggagttgaaccaactaacataggtgtgctatccatgtgagaatccttcggaaacatttagcttgacaaattgaaacactggaattaatcttaaaaatctgtattaggattgcattgacaatgtctagtgttttaaaatggcagtttattctctgattttaaaagcagtacaagttatccgtggatatttggaaaatatagagaaacatgcttagctatgtaacaattaccctaaaatttaacaacttaaaatgacaaacattaattttctcacacagtttctgagggtcagaaatctgggagaggtttaactgggccatttttgctgtgtctctcctaaagtagtagtcaggctgtgggctggagctgctgttatctgaaggcttgaatggggctggaggacccatttcaaaaatgattcactcacatggctattgactggaggccttagttcctcactggctattggcaaaagatgttggtttttttgccatgtgggccacttcttgctgcagagtgagtgatccaagacagagtaaagtggaagctacaatgtcttttatgaactactttcagaagttacatactggctgggtgcagtgacttgtgcctataattctagcagtttgggaggctgaggtgggcggatcacttgaggccaggagtttgaggccagcctggccaacttggtaaaactccgtctctactaaaaatacaaaaattagccaggcatggtggtacacgcctgtaatcccagttactcagaaggctgaggcataagaaccacttgaacctgggagatggagattgtagtgagctgagatcacatcactgcactccagcctgggagacagggagagactctgtctcaaaataaataaataaataaataaatttaaaaagaagtgacatactgttccttctactgtattccattgaccctactaaccaaccgttatacagtgtgggggataatgacacaagggagtaaatgccagaaggtgcggatcattgggccatcttgaaagctatccaccacacacagaaggacatagaagttacgcttaggtccaccattcagtccctgtggatcttccaggtttttgttttcccttccattgcagcagaccataaacatttcttatattatgaaatagtgttctaaaatgagatttttatatgtttgcttagtatccatttttagggcatgccaatttattttaccagtttcttaacattattttataattgggttgttttgagcatttgactattataaattataatatttcttgtctacaaatccttgagcacatctcctgccatttacctaaaatagattcctagaaatgttactcctgggtcaaggcatgtaaacattttaaggctttttacacataatgtcaaaatattctgcagaaatttgtacccaaatttatactagtattgccataacaaaatgatgcctaacttcttatgtgcttttcaatactaggtacaatattttaaaaatataaagagcctgataaggaatatagtatctcatggcagtttgaattttttattactaataaggtaggggaattattttaagagtcttattcttgaatctatgtagtatttttcttcttgatttttaaaggtatctttatcataattacttttaaagttgtaattagttctctttaaaaaaattatagtttgctttctttcaaaatttatttcactggatgttttcattaaggctatacaatgggagtggttctgtaatgaacctggaagtgttgaaaaataattgaataacttaagcactttcaaaataccaattagtttgttggtgactaaactaagtttctctaacttacattttattgattgaacatttgctagaataatgagttaaaaagtgagaagatgcttttttttttacttttgttgtaagccatctgccaaaatttggtgagtgctgaggaacatttgtcaaggaataaaatcataattgagagttgtctagtctgaaaaaataataaaaacactctcagtgtttccatgtgatagaatgagaatgactgttattacttcgaaagtttcctgcccaggactttcatataactgatgttctctgtgttgtacaaaaaagaaaataaataatagcttgctgaacagttttctggatttccaaaaaactttattttggtttttgatattttcataataattggttttaaatttgaaagttgttaagtaagtttaacagtgagagtggatagaatatgttgtctggcaaggcaggagcagagtgtagcagggagaccttggaataaggcgcttattttatagtcaactctgtttcctgccttgtggctttggtcctttcagcctgttttctcacctatacaaaaggaatacattttgccagatttgccagattattttcaaaactaagttatataatgtacacatagtgcctggcacacacaagtgcatgatacatgtataaagcaacaggaataactatggaaatgtgtactattcttaacataagtagttggaaggggagatcttcacaagaccataacaaaatgaaaaattcagtgatttgtaggtgaacattaaatttatgctataattctgaccaagagtgtatgtgatgggagggaggggaacaaatatttattttttgcaccagtgaagagttttgcaattatcgcattgctataaaagtttgctgaaagattaaaaatagaataatattagccatgactattcagaactgaagaccgtgccaaacaaagcaagcaatagactagcagtatgaactttgaaacccatagatgtgatgaattctgtggaaccagctcttaagtgtatagatacatagatgttcatgatttcactgggggaggctgatgatcataggtcttgaactggaattgaagaatgggttggtttgtacaagagtaagagagaaggagtgtcataagcccaggaatagtatggacacctacacagagacagataaccatgtagtgttttgctgtgaataaattgacctaacctagagaatctgtgtttgggatgcagtatggataggaatggtctgatcagaatactgagaaccttaattgtcaggcaaaagagatgaagcaaactgtagaccatcagttgaaaggttttagagactttaatgtagcagtgatgcagggtctctgtcgtagctcagatgtgggatgcactcttaaagtgagctcagtaagtcaggaagaaagcaatcagattccaaacactggaaccataatttctcacttatttcctactcaagaagcttttagtaatgttatcttgttctcttatgaatatgttgttttaaaaagaagaaattaaaatgtgacatagctgttgctttcctttggttgacctcacttttactttttattttaacactttatttttcaagaaaacacatactttgaaaaatcgtataattataattccacagtgacaatttctataatattttgcatttctattcctttttttttttttgtgacggagtttcactctttttgcccaggctggagtacagtggtgcaatctgggcttactgcaacctcctccgcctcccaggttcaagcgattctcctgcctcaacctccagagtagccgagattacaggggcccgccgccatgcctggctaattgtgtatttttagtagagatggggttttaccatgttgtccaggctggtctcgaactcctgacctcaggtgatccgcccacctcagcctcgcaaagtgctgggattacaggcacgagcccaattgtattcctttcttggaggtgtttcctatgacttatcctggctacagacctgctggaaagggagtagcatttatgaaactcctacattgtattatgcatgttagtctcagcatcccatttagtctttacagtatccttataaagcagatgatgttattcctattttacagatgtgtacactgagcttccagaaaattagatgactggtaagtgttagttcagaatgctctgctttgtaacatgatgcttcctgagagaatctggggaatgcacaacttttggcaggagaaataaggactaaactaagaacagcaatgttaattttttttttatgccttagagatagggaagttagtctccctcagaggaatccaacttgattttttctgagggatataatatctagtcacagggctgttcctttgcttcctgaggaagtgaaattcactaaattgggtagtgaccttccatatttaaagatacagttacagcttgctttagtaaaaatgttaacaaccttggaaaatgcaaaatatctgatctcaagaagattctgatacccttcattaatgaaaaaagaatgtcttgtttcctttctactataatgatcatgaattttccatgtcactctagttcctgaaagaagtgaattagtttgctagtagtgggtcaaaggtaactttctccttttaaaaactatgatgaaaggtgcgaggtttagatagtatggggaacttctgagtttctaaattataaaacacattttgaaatttgaattatgtgctgcttaatctggttcataattcttggtttcaaatactaatggaaatgttacttgcaagttaaaccctgaactgagaaacatgcttttctttattcttttataagtggctcttttaattgtagttcttttaaaaaggaagttaacacttaagtatctattaattcttgacaaggaccttattaaacctaagcaacgtgttttcaaaagggcaggtagctgttagctttatgtgagaaactaaaactaggaaagtaattattatgagcttcttaatcttttattttttccaaaatagaaatgtccctattttttcttattataaaaggaattgttaaatgtttaaaagtattgaaacagtactggacagtatacattaaaaagtgaatgtttcccataatcttaccccctacagatgaccactgattacagtttaacacatgtttttccagaacttgttatttgcaaatgtaaacctctattgctgtctacatatttaaaacattttaaatgggattgattgtactacatgtactattctttattttgctttttcttattgaaaattgttgttgatctatttccccttcagtaatgacagttctgtttcttagattgttggtttgttttgctattttaataacagtatgaagaaatacctcttttgtatgtttttgcacacttctctatttccctaggctaagttcttacaaatagaactgttaagggaaaggtaatgcatattttaaacttcaatatatgttcataaactgctctctaaaaggttttgccaatttactctcttgtcagtattgcaggagaaagtcctttttgactaactcttttacaataatatgaataacagtttttgccagtcaggtgagaaaaaagaaatgtatttctttgattattagtgtagttgagaagaatgtcatatgtttgtgggcctttatgtttctctcgggaacagattgttcatgacatgtaccttgtttttcttaagggtgtttgttttttctagtaatttaaagagcttttaatatagcctttgatacgtatgttgtaaatatttacatacgtctttttcttttacctcttatgatgatatttgttgcacaaaatacctaaaagttgacatatttacacacatcccattcttttttgcttatggtttctggcttttgtttgcatgctaagagtaaaaaccccggtcaattttttttttttttttggatgccaaggcactttatgtgcatgttcttattgaaacctcccagcaacccaatgaacagaatactttagcttcccttttatagatggtgggtaatcacttatccaaggctacaccgttttaaatgatagtgccataacacaaatacaggcagtcagatatctccctaggcccaagattattaatacaaacaaacaagaaaatctcctgtattgtagccactgtgttttctttttttaattgttaaatatttaattcctgtggggttcacctgtttaatttcattttcattttatactgtttatttatatatgcacatgtgtctacatgtttcctatatactcttattataataatcatcatttctttgtcagtaaaacattctttattctgattttagagtaatttttatatctaagggaaagtctccctctttattttgtctttaaaacttctctcgactattcacacatatcttttcttccagaatcaacatgtaaaatttaatgtacaaattctccttttaaaatagtctgtaattgcactaattgtaattgcacaattatcgtcattacaatatttatctttctattcaggaaaatagtatgtcttttaattaacttttttagtaaagctgaatagttaacttcatttagatttggggcatgctattgtaggtatattcctgggttaaattttgattgtgctcattattgttcacatgtacgtatgactgcataccattttgacagtgggtacatgttaaatcattactgtttatgaagtcagtgtccatttttatgaatattatgctagttcatgtcctctttttagacattcagtgttagagagtgaggaataattttaatgtcttgatggccaagactctacttaaccagctgttggtgactgaaagtccagtttcctttagatatgactcatagttcttggttggttcaaattctggatatcaatttaaaattgtatttaaaaccatagtggtccttaggggcccagaattcttcaaaattgaactgaaagtcacatagcaacatggaaataggcaggaagtcacatttaaattcttagcacaaattaacctccgcaaacaggtttgttccctgccctgccacccagcgtgggtgcttgtgtcacagtaggttctgggaagggttcagtattctcttgagattgggaggcacagaaacatcacacacattcacatggaggctctttcctaatccctccattactgctccctgtctcccataaccaagagaaaggaggcctttctttacaaagcgtgaccaaagattgtagaattcgaagttgaatggagagtgtataagaaattgaattcctaaaagaaatatgaggatgtaaagtaattacaataatcaaagaaggtcagagggaggagaaaggataataaagaggaggtaaataagaacatgaagaacattgaaccttccctttgtccccccaaaaaaagctgcagaggaagttggaggatatagaggatggatgaaaggggcaagacagtagaaaaatgcagcaaagtaaagatgatggaagtttagtaaaatggactgatacttacaggcatagttggcttaaaaaaaaaccctcactgatcctttcctttaaactgctcagtagctaaataaagaacttgttgatttctctctctttagcaggctctttcagtagtacattttgaagatttcttcatagaacattaggatattttactacctgactgaaagtggataaacagaactggaagatttctgctttgcacatttctgaagctttattttatccttatataggtaaagagagaagttatacactgagtatgccaaaatgaccacatgcttcacacttgcactacctctttttatgaatctaaatttggagttttcaaaacctcctgtttaaaaatacatcccaaaagacttctgcttattgcacattttgttcctgtcctgtacaactgagattttcatttataattctttttggaatgtttttctttttgtcataaatacaaaaggaagctattgacatataatccttcattatgttttatgcagtagcatcataattctcaaattttgagaatatatattttttctttcaagtctagagacaaatcttacaagaaagtttaattatgtgttcatgcatatacatggaatcttaaatataattgaatgaataaaaattaagttgccacaaattagtttatgcaggcatctttcacttaaaagatagtttggaggagaaaaaattcactgacaggtttttctattatatgatttatattttcctgttggatttcatgataaagttacagtttcattttatcaaagggaaaacttgttccttgatttttaaataggaagtcatattcagagatacattagtccttttaaaataacatatttaaacataaaatagtaatcttataaaatttattaagtcatacttagagtattaactgttttctgttatgctcaataaaaattataaattaaaaatgagggtaccagaaactcttaaaatataataatctatctctcctaattttactcataatataattcattaacccattattccatcttccaaaatgctaacttgcctctttccagctatcttgaaatgtacttaactgtaacatatctatactttaatgtatgtcactgaataagataaatttagagtatgtgaagtttaaggctgaatgttttgtggaattgttctttaaactaacccaaaataccacctttagactgctatagctgatactggagcatgtttcttgtctcaaggagcaaataatctttctaatattaaaccccagaatcagagagatgtacccatccagttttgggagtggtggacaactgcaggctcccctgcagggaaaagacttggcccctgtgagacatacagcacctggaggttgagcacatgctccctgtaggtgagctaactcccaggaaaaaaaaaagggatagaagaggcagactatacattgccctttttaaatctaccaggtcagtcactcctcctggaagaataagtgtcacgctagtagtgctccttccataaaaaaaactaaaggagtggggaagaatcattccctcccatagcaataatgatgtgtgtaagacagagttgatgaaaaaggaagtatggaatatggtgggaacatagcctagcctaggggttcattggaagtgatatttcagctgaaggaatagggagtaggattgaggaaggtgggtttgggcaagaagaaagatgtcttaacacatctgtggaatttacagcaattcagcatggccggttacagcctaggctaagagacagaatctggagtgatatagcaggatatgtaggcagtgaccagatctcagagtgagttgtgagtcaaattcagatgaataaagggcaacagaaacatttgaagggtttcaaatagagcgatgacagaatcagatttatgttttgaggggacaatcattctaactgtaatttggagggaagcaaagctagagagaggaagatctattagtggtatgcaaggaaaggaggtttgtgggaggggacgtgtagattagtatagttttataaattttgcccttgaagagcaagacattcaaataaagttgttaagaaagttagatgggtgcatacacataagtctttctgtgaatgccttttatttgaaatactgatcaatgggtttatgttaaagctagggtagccataaatttaattagccttctcccattttgatagagactttgtaatccttctgagtattttctttagttttctgatgaatccacttatttaaataaaattattcagttaaaaatttttttgaaagaatataaaaattcgctgtttcctgccactgtttactacaagatactgttgatatgtggtaagtgttctggtttatgggaggagaaaggaaagtttaagttcatttttgggaagacacatttccattgacattgaacttgctaaaattgcatgatcacacacaaagtgattgcacagcaatttttttttttagttgctgccaatatacaactatttaaaggctggactatttcaaaagataataatttgttatcaacattcttaggtgcagataaagagcctggaaccatgtctggtaaaacccttcccaatttacaccagaaagtctttggcaaaggtaatcttgtgctgcttagctgaaggcccttcagtatcaactaataatgtagcctgctgcctgctgtcattttttcactattagaaatattatcatattactatttttgtaccttttgtgtaatgttataatagcttctaaaggttttctcctaatattttgagaacttttgtttgcattcttgatttgaaacagtgtgacctgttagtgcctatcggatgaattatactctttgaatgtctctttttctaagccgctgtgctaatacactttttattcattttcccctgtgttataataactatgtttaagtctcatggcaatcttctttagtctatatatgctgaaaagatttatttgcatttctatccagaataaatcaaaataaattttgctggaaatggcatcatgtgaattgagtttctttagcttgcaatttttaatcattgtgctttatctggtggaaatgttaatgtttagtggcaaaagaattgtaaacagtgtttaacacacctttagtcacagacactttcatagaataaagggggttgtttaatactccaagaattactattcttatttgaattttatttctattgttgccaagtcattttttaaaaagaaaaatgatcccagaagtagataaccttttttttttttaataaagcagataaacttactgaaaatgacgtataaaactcaatttttctggtaggtacatactcttttgattaaaagttatcttaaacgccacatacctgaaaacacagttttacccattcaacaatcttgatgttcactgtcactgtgataaaggaaatccaagatattagatagcaatattctagagaaaaataaacaaattatatttccttcccctgatgaagttgtctagaaagctcatccaggccatggggtgagaccaagaagtgagaagttctagtgtctgaaaggaactgcagttgaaggactttattcttagcattatatatatgtatttttttaacctctctttggttctcagatcaacaccaaaatgcatgtgctcaccttctcttgtctttatgttttcagtaggaggaaggctggcattagcaatacaactttgaactcaggaagaaagtttagcctgaaaaagataggctgactagggtaaagtttgcagccttccaaactagcctgttatctttataagtttatgaggtagtaaaatggaaccaacatttctaacagaatacagtcgtgtgagcctgtcattctgaaagggactttatgtgtgctgaggtcaaaatccagtatgggaacccatgcagggcaggatccaggttttgtggcttattagacttgtgcagtttcatggggccctctttaagaaaaagaatgtggaattacaaatgcaaaattagtgaaaagatctcggaaggggcctatgcaaggaaagggccctgtacttaaacttcattaattcacaataaattcacttctaacctcatacataaacctgtatctaataagttaaattgtgaattgataatacagctaaatattttaaaatgagattgaatgtcacattcttgaggaaaccttccctgattgctttctttgtaatgccactgtgtcacatatacatggtgtggtaacgatccatttacccatctaatttgctcattagattctaagctgcagactggctaggatgtcttgcccactgctgtatcttttgtgcctagcacagtgcttagaaaattgtagttgttaaaagtagagtgcagggatgctggagtcacaacaccttcgaacgtattccagcagcaggctcggtgccgtgcctgatgtgccgaaaggtgcctctagtgctattacaatgcagacacagtttccatcaatcatatggacagcagctgccaagttctcttttacttggtgagttatggatggcaaagatgtctttcaactatgcacaaaaattggtaaagaactggctaggtgtccatccgtcaggtaggaaggagtgattataactgatctgaaggtagagtgagatacaaaatgccctctgaggatattttacttattcctgagagctgctgctgtctttgaacacctttgaacatttactttttaagacaattagatcaagggaaaaaatcatggaaagcatgattcaaagatcaaattcttcaatttgatgaagtcacacttcatctaactgggtcattgattttaaaccagaagcctatttactaattttacagcaaagatatttaactgtttctacaagtcatcataataaatgttatttctaatgaacagtgtcttgaacttaaataagagagagaaaaatagtggcatttcctctactccccaaataattctattattgcttaagtttagtgtttataagatttaaaaataatgggtgcaggttgggatgaggatctatataaccatggtggattatttttaatactgagaaaaacataggataaattctgcaagtactatactttttctgccaaaggagaaacatcctaaaacaagaaacttaggggctgatttaagaaaaagctggatgaaagatgtccagaccagctacataatttatagtgcccagtgaaaaatgaaaatgtgggaatcctggttaaaaactgttaatagtttcaagtcagcaacagcagagcattgaaccaagtgtggggctcttctaagcttggggcacatgttacgtgcccacgaagctagcccttatagatgcctttgcgtggttcctgagagctgctgtcaaagaccgtattcaccatgtaacctggtgaattgcaaagaaaaattcacatgataaattcctctttgttctcagcaccagaatagcatttatcacccgaaatgacctattacgttcctgtaattgagcaataggagctaccagaattaaatgttgtgctcaaatgaggtcgttttgctcagtctgggttttgggatgccatttcgttgttgctatttgactttgattttatatgcaatgttaatgggttttggtctttgtgttctaaggcatctcaaatccttttttggaagtagagacagtacgtaagtaaacaaaactcttaaaagtagttttaaaagttgattttaaaagcctatcatcaacattattcactggtggcagtaatagctctattaatgagattaatgcgttccaacaacataattattttttagagactccataactacaggcagaaataatccaggaaagcagaaggatgtgttccacataagcaagaatatataacaaattttaaatagtgagaaaagtatctttgtcttaagcaaagctcaggcaactaaggttaatggaggtgaaggttggggctagtttataattgggaatggaaagcccactggggacaagcttagagcgagggaactgctggcagacaaccctttgctgtggtgatacaggctcacttcagaaaatgtaacatatactcttttattccctgaagtttccaggagccttagctgggatcccagaacagtaaggaaccagtctggccttacagtgtgcatttgtgcattcttccccaatcatcccacaagaattaaattggattgccctttaagcagggctgccatgttcagttgtggaagattttccattgcatagactcattgggtaataggcagtggcatctgcgtttctccccactttacggcgatcaagctgcatcccctctcatggggctgtgctccccactacaccagtcccaagaagaggcaccatatgggctagtgtttaggactacctgagtcagctagataggcttagtaggcaacctaagtattcaagaatcccttaaagtgagaaaatgcctttccttatcaggaataaaaaacattgccaattagagagctctagaaagtgaaaatattttgagttaattttaagtatgaatgagtgctaattagagtggaattttaacagcagtcattctccactttttgataagattatgggatgtgaaggaccagagcctctatgtgggagttgggagctaggaaatgcagaaaattgatgcagaaggaaatagcgtttctcattacgttggctttggtttacatgcctccttcctaaaggacttgttaatttaactattacttgtatatgttaattgaagtactactcgatttgagtgtaattttctctaagtttttcttatcctttggtacaaagaaatcatttgtattccattgttaaaactgatgaaaacatgtgaaatcatacatgaagacatggaaagatacaaactgaaaaatgagttaacattgttgtaatattaaatgggaacaaattaatttccatcgaaggtaaaataatgagtgcatttgtgatttttgttgcttactcatcataattatgagacattatatttaagcacatataaaataagcacactttcacatttaaaactctagtgatcttctgtatggaacttacactgaaataactgccctagctggggtcgtctccctccttgattccatcgggcttggctgccttccctcaatatgtgttgagtgactactgtgtgccacgtttgttcctagaggatccaaaacccaaaccagaagctcccagggttgcagtgtaattaatatggggtgtaattatagccttttatgatagtctgtttctttccttgttactgtagtcccaacacttcctgagatgtgccctttaaccaagtttgtcccaagcctccacatcttaggaaaattataaacttttctgtgttctgtcttttctgtaaaacctttacctgtccccctagttggacctaatcacttcctccctggtgtttcacagagcgcctcaaaatttacttttctatcgtagttatttctatttgtgtttttatcccccactaggtttcaatgtccctagaggcatggattctaatgaattcttgtatctctattgctcatgatatttgcagaatgcatttctcataattggtacttactcaaaaatatagcatattacacaaatcagattggattacaataatggtttgcatgccaccagttcagggacacaggttgttgaccccaaatactgtagagccaggttgagttactgtcagcattcttaattcatgtttactgcataacagaaaatttaatgccctttgcccaattcctgaataaatccactattatcattctctgctcccctttctaatctgctatccatgcaaacatcatttccattaatttatgagcataggttcataataaacagttttgcgtgctgtactcttctctcagatatctaggagactcaattaaactaaaggaataagcaattttgtctataagtataaacttctgaaaaattgttgcccccaaacagcctttaaattctgagagaagcatgtctagaggtttcttatcaagcttcagaaagtacatccttctgaacatttttaatggcagctcataattgctgcccatatacatcagaggattacctaaactgggcttttcctgcagtgaaacagtgtctaataatttgagatgaaattctaattattttaatgagatttttctgcttcttggcatcaagcaatttgttttacacctttactcattatttttcatttttgaggacttaaatagaagagacatgacagaataggagtcctgtttcatctcttggaccattaattatgccaaggcggtttcagtactgatgagaccccaagaggaatgaatctttttgggtcttacttggtttaacggatttcattctttatacttcaaacaagttttcttagaaaaccattaatcactaaactatggattaaatagtgacaataatggaaatataaccaagaacaaattgttcatggttggtttctccaaggatttgacagctaatttataaaacaagttgtttttgttcagcaggacttttgtgactaaagtaaaattgctttggcaaaaggctcagcaatattctatagcctgtaggggaacggagcacacacagaccttcctccttctttcttgaccctctttccttgccactttttgcaagatttcaatttgcatacctgtcctgacttgttgccagcatgtgcccttgaaacagttactaagtttgctagtataaaaggttctgaaatttgttttatcttgtcaacacaaggtccacattggagagctttcaagacatactgtaggaaacttggcaaataggtaaaccaagtttttttttttcttaagtttggtcttcattttatatagtcatctgcatcaattacattcatagtttcataatccaaacaaacactgacataaaatatgtaagggttgctttcttaatctggacgttttcacctttgttggttcttcagtttgcctagctgggtgatgtgtgttagattacgtagttgtgtgtacaaagcgagagctttctcccttccagacacatgttatatgagggaggcagtgtaccaggtattacagagtgctggtaattaagcctgtgctgggaaaagtagggccaaaaccaagaacacatcttggatgcttccctcaagggtcttaggtgtagttggggaacataattgtatttaaaattgtgaataacagtaaaaagcagtgactgataaattgccaatatgtagaagagagaataagtgttatagaaatctagagaaggggtaggtaggctagagtggccaaactaatgttatttcttagaaattgaactgaccgttttcctcattcattcttttattccatctactcatttattattaaccaccttattaataaaaagcagctaacctttatttagctgctcaggcactgagtattatatgtacaactcatttaatatgccatcgttttgcagattaggaatccgaggcatagcatttgaccaacttgataatgagtggaagagactggtgagaaaccaagtctgtgtactccagagcctggctcttaaccagcatgtcctattgttttttgcctaacatttgctgacagcttgtcaagtagtaggttcacagagacagctgggatatagagatagtggaacaaaatccctccatttgagaaaccacagaagtaagtttgaaggccaaggattctgttgcaggacagtgatggtagcttctgaattcaggggaggcacacctgtgggaacatttggagatggagagaaggaagttaatgaccaggtggtagaggactttgaaagccagaatgtggggtttttgtttcatccatagcttcacatgtcatcttaggaccctctatttgggatccccccagagcttgtgaaaaaagcccctttgggatcctttgcccagagctcttgttcagattcttcttaggggtagggctctgaaatttgcattttaatcaagcaccctagatgattgttatcccatttgatgtggaaaatcactgctgcagataaaggagtacatatggtaaaacaccatatttgtttatattttaatatgttttgcttaaatgaaaacatttttgtgtggtataaaaaagagaaaatctttatcactttatcaaaatctgactatcactatattgaagtttaccagaggtatattggaaatatacctccgagagacccagtatgtcttataggcagtggtattctggtaaatgttttaacaacgaactctctgaaaacaatgcacaagttttgatttgtagcatttgttgatttcaaggtaccaacttaatgtcactgaacatggggttaggaagagatgtacacagttgggtccggttccccactgcctaactgcctatgagtttgaccagtgagtgaccggcagtattagaagtattagtgagtatttacaagaaaaaatatttatatgtatccaggttttataaacttttaaccacttaggctgattggaagttatttgcatcataacttaactttaatccttaactattttcaaagcatgatctcatacattacctttgaattttgcaaatattctgtgagattgccatggcagggaagatattagccttattttgtagtcgagaaaattgagagcaagtaaatttaaagaacttacctaaggtcacaatgctattaagagacaaagactgattatttctagtcatttctcttcactgtatactggatcaatactatgtaacaagctacaggttacaaccaagggggcctatgtgtacaatgctaagatactgacactaaggatatagtgaaatcataatttgggtatattagtagaggtgcttctacaactgcacatttctttgcattatactgtatgaatcatcgtcaagttgagacaggtagggtactccttccaccctcactggagttgttttgttgtcaaacgcagagatgataaacttgagagaaacagttcagagactggaaaaagaccaatgaggagctaatgtcacctggaagagtcttatccttgttccagtggctctcattgcatgatccctgagacctcctgcagcatcagcatcaactaggaacttgttagcaatgcagatccttgggtccccacctcagacctgcacacactgtgggctgtaatcgacaagtcttccaggtgactttgttgcttcctgaagtttgagaagagccctatatcatcccctccaacccagaaaccctagagaagtttgtgggatcttaaagaagagaaggcatgagtgtcttattccaagttgacagagtttaaatcagaagtaactgagtagtcactaattagattgcatttacttgaagtgactcaattaagttgtctgctgttagctggaattgggggtttaaggtaggaattaagttcagtttacggaaattaagatagttacacatcatacacacctgggtttgtagcttataaaatagaattttctatgtacactctggatgcacttgcaattttgtcctggaatgaaccaaacagatgaagtgaacagacagaccttggtgcctcatgtagtgtcaggaggtagttcatacacttggccgaattaagactcatgatgtacggctgtgggggtgggggcgacaaagcttttgaaatggcatgctgtggcaaaatatgatccacgtgagttttccttggcctttggcaccatggactctggccccctaccccatggccttgacttccctgacctgattgtgcttagtgcttctcctgcagcttggcaacgtgcatcatggtctcaactagtgctaccgactcatcccagttggcttgagactttctcagttttaacaaagaaattcccatgtcccaggaacctcttagttctgggcaagccagtagagttagtcactctgttcgtatcccacttgacttaagacctccactgggtgttttctttgctttttccactggtgcaggttggtcccgcatctttggcaggctggcaaccccagcttacactgttgttggttggggagccagggcaactggctacggagagttgctgtgaaagagtcaactattactttttgtacatgtaagatttgtaggaagcatgattagaagttatttttaggctgtgttgagtatttcttgctgatttggaaatatctagtcacatgtaactgacatagtaatttaataaattaccaactgcaatttattaaagcttggaaacatcttgctgtggagtgacttcaattaaggaaaatcactttgagtggaatttgaaaacttggcatggtactggggtattggttatttcgaataaatgggtgatacctgaaggtggaatcttaagaaaattaattctggcatatgtggaataaaatagagggattatgagtatggaggctcatgggagaacacatgttagtctaggattgagatgataaaggcacactagggagttaatggtcagaataaaaggaaaatttttgaaagatattttgaaggaagaacggatgaagtactgagctgggtaattgagagaatgatgacattattaatgaaaaataagccagcctaaatttagacaattgcaatgaattaaactttaggactggtaagtgtcaggaactcagatgatttcaaacagttaaggatttgagataaggcccaggagaaaggtgtgggctgcatatgttcatttgtgagcatcttatcaaaggtgatggttgaagcactggagttggtgtagtattcttgcatcagtaggtaggtgatcatcagaagcagacagctgagttgagtaatgtcaatggccataaatcttttgtttggtccttaatacatttggtgctatgaaattaacatttattcaggattttattgtggttccttccatgctattttagcagtgaaatttcagtgaaccaattagaacagtgaacttgattgcacatgctaatgaagatcttcttaattaacttttaataataaaaactccaagttctcaagagctagtttacttccataatgataaggaaattagagtttgagcataccaatagtagtgtgatcccttgatttctacagcatttataatttgcaaggcattttattattttatcaatgaccaaaaccctttgggacagttggctttctctctaatttatagataagtaaactgagtctcagagtgagtgcgttgcttgcaaaggcatgtagtaacatcagtcataaccacgtcagattgtcttttagttctttgaccgatgaactttccacagtgccataattgctggttgccacacattaacactagcgtagtgggaggttcctccagtatttccccagcgcagtgtagatttcagaagcttttgatgacatgccttcattaatcagagaaagatagaccctctatatatagaagttttgatggataaatatatctgacattgctataaggcgttagtaccacaatttttagattcagtcatcttcactgagaacccaggaataaaattaggctgattgagggcagaagaaggctgagccaattaaagaaaaccctgggaagccaggattaagtagcacaaagacaaagatgagtgagctgatgaaattgcacccctagctgaaaagcagcacacttgaaggaaaaccatagaatgttccgctaacttttagcagtgggagttacataatctaataattaattgtctgtagcttccagatctattagggaggtgtggaacagactccagaggcaaatcactggctcctgtgcaagtcaggaacattgccttaggcactcagcttcaaattggtaatgtttacaagttgttttccccataattttttaactctgggcataatctttttcctcttaatgggtattttaagtgtatcttaaagatttttcaccggctttacacttacgattggaaattgtctagtttgtcactatacttctgagtgtcagagtacacatcttatttttgttttttttttccccctaaaagacaatgttcaaaatacaaggtgatagaatatccctggcacactggagaaaaactgagatcatgtgcaaacagaaggatacatccttttaaaatagtttaaactgccattagaaatagaaggaaacccattttatctgggttactttgacagatgtaactctcacaaaggatgaatatcaaccaccagcaccctcttgtctgacattctgacttgaaaaggaagagcccctgcaaccacatagcatggagaggagataggagagaggctgtgagtagatgaaggctttcagtcatcaggggccataggtttcgttttgatgtacataaaagctgaccaaggactttgtgaaaactttgggctgccttcctgaccaccttggtttttttccttcacccgtagatcagcgtcattgacaactgcattcttttcaagtggcaaaaagaagttaaaaataaaattctattttagatgtacctttgattttcttcaaaaacatttcagatgacatgaaagagaaatacgtgataaattttagcagagacctggcagagtcttcctatagtttaatcaaaaatgggctcagtttcaaatatattaagttgccacaggagaatgggaatgacttttgggaacagttaatagttcctggaattttaatccccttttatcacaatactgggtaaaagttccaaggtaagtaggcaaataatacttaaaggaatattgcatgaaatgtaagaggtgacgtatttaaaagaagtatccttgtacagctcgcctttcctgtgataggtgctgcatgtttttttttttttttttctggataatttgtcctggactttgtccaggacagaaaacttcggtgtttctaaagtttatttagtcggtctcatctccttaacaatgtcagaagaaaccttttaacttggaacttggtaaaagtaatagaaaatattgtttaagatctaaatgtaagcatttggggtgaattctttaaaaaagtctggctatttcctagatttataactgcaaatactgtacaattaaaaccaccatggtattcctcatgattcttcctatttgggtattgatgaaggccttaatcaaccatagctgtttagaattttgagtgtagattgtaatttgggatattttctactggggtcctggatttgcattgtgttctgatttcttaccctatactgcattttcccctatggaaaaagtaccttccttgtattggaattttttaaaagattgcagttatttgtaatttgtaatcccccagtgtttctagtttatatctttaatgttgaaatatgaagaatattttattctattttccaaacagctggtaagagaattcctctgagaaaaaaatatctgcctggactctcacagtcgtctcctaatttatctttctgcttctgctttccatgatttaatttttttttgtacagtatccagagtgatcctattaaaagtcagatcacgttactcctctgctcacaaccatccagtggcttcccatcttatcagaacaaaatctagaaaagtcatcctcttccacggttctataagtgatatgcacctcaaatctttctggcctcatctgtaaaaaccctcttccttgttcattctactccacactggccttcttgctggttcttgcatacagcaaacacagacctacttcagggcttttgcatttccctttatctcttctcccagaaatttgcattatttgcctctcctcctttctttcaggtctctgctcagatgtcactgcatcattgagaccttccttgaccatctgaagttaaataggaccagtacttcaggtgtatacagagtccagaccgtgagatctttgatctcagaaattaggagatacccttaggggattagggcttcccaggttctagaattgagatggtcgttctttctaggtcttaaaggccaggggaccccagctaaaatttgggtaacttcaaaatacaaatactttcacttaagttacactgctgtttatcaactatgtgtctgtagttatttagtttgttaattgttactccacaaaacaaagtatatactgaaaattcataaagcctatctttttgcaaatgaaaatgtgatctaatggtctctttgtgaattccttcttggaaatgctccattattgtcatagttggtttatagccttccttggtgttaaaaagagaaaagatgttttctctttccattattgggagctcttttctttctgttgtttctgttcttcctgccctgtggctgctcagattctgtgtacagctgtttctatgaagtaatctgtgatctcctcacgttgctgcctctttgttgttttcactacatgtagaccacagtgtcacaataagacaagagaataaaataaaatgtttcctattttattaatgatttaaaagtccaatgccattattcaatgaaaagcccaagtcaacaacattttagtgtaatttagtgagaagtgttctggtcacttggctcaaccatgcctgcaagccaagtttcagtgtttcctgacactgaatcgcctgagtaccattgtggttatacatatggtgggatgacgtggccagttgaggtatatgtattaatatgctgaagaaaagagagtagtggcacttgcttcgtgagccaaaaaactgcaatcacttttaaatatatgccacaaggctgtgctgggatatgaaggaaggtaagatagagcctaggtctgtctagggattgggctgcttctgttatataaccacagcaagtcagttcagggattttagcaaacctttgggaatagcagggactgagctttagatgatggctctgaactgctggtttccaaccactagggtgctctacctgtgtcagattttcctggatcccatgcatttccccagtccatggtaaaggaatcactgggtatctgcttgtcattccccaatacacagcattctaccacattctgacttagaatttccttaccactattttccccccactagcctctgaggagctttctgaacatatagcccaactccttgtatatgtaaggcatttgttacactttgatggagaaatgaaattgtgtgacttaacaactattatattttcttttcattaatccttgtactatatttgcatgagtagaattttgtaaggttgtaagctctaggttactggaagaaacagaagtccgattgatttgttctgagaaaaatgactggataacaaagctaggcatatagagttgaatttaaatccttgagatgatctaacctgataatgtaacatcatccatctgtaatattttctcagtcaatttttctggtattcttcattttctttttgagaaagtgaagcatatatttatagcattatagcatatatttatgccattctctattcttaaggaatagagacagtattattttctcttcaatctgtatttcatagtgacatcaaagtaaaattctacttaaattgtgtgctaatcatagctttttatgttttcccttttctgccttctacttttttctactatatctccacttcaggtgcttctctcacattttccttaaatgtttctgtcagttccttagtctctacaattcaagagatttctatgaatctcttggtctattatgtacctttagaatggaagggtcttactagaaaaaaaatatttttatctgcatcacatttgttgacagaaagagaccttcatgctctgttgttaggtgcataaactagcacaaaacaatagatactgagtgctctacttctggaaaaacaaatattttgttttagctatttgcatatgaaaagatgtggaaggttacttatcaaaatattaactgattgagaatgtttagagtcttgttgattgcagttttccttctttcttttttccccactatttcatgcattcattcacatagtcattctttttctgtgcatttttattttctgattttctgtattactagtgtaaaagcaaacactaattgggaaaatatacaggaaaaaatgttcgatggatgtaaagaaataattgtgaacgtttatagcaccaatggtgctacgaaactattcttgacttccttttctttggttctaaggactaaagcataatccctacttctttggagctttggagggcttggattgtgtcttcctcttagagttagaatgatccatgttttgccaaagtgttcaagaaagggccccatgttggatgtcccttacagctttacctgggcatggagaaggcccagtcacacagtgatgacttgtagcctctggacaaatgtcatagaatggctgtgctccttccaaattccactcagagtggggacagctctactgcttgctgagcagtctccattcagaagtgtttcccttaaataatatggcaaaagccaaaaggtaagattggggaagaaaacgtggacctaggctaagatcatctcctctcccccactgccacctacatgtttgttttgtttacttgaatgaaacatggagctgttttaaatgtctgtgtaacacagtggtatcaataaaatgcagcttagttaaaaaatttattttatttttctatctgtgattacgttaagcttccgtgaaaatggaatgcaccagtttcacagcaggagaagatagatacagcaagattagggaggcaagatgttcaggattagaaggatctgtatggctgaaagtgaggtaatgataatgattatgtgataatagtactgttgtgctgttttgtgaggcagtaatccagctcccaaagcagataaactatgggggagaaggctgagtttatcccatggaggggaatagactgttgctgaatagcccagcatgacagtaaggctctttcttttttgaggcaagagctcaaaagtaagtttttaaaataaaacgagtaacttcccaaatacgaacaagtgaacagctgagcaagggtaaaagaaaatccaatagtgcaggagggtgaggggttggaggggtggggatgggattctttttatgcaacaaaaactggagttctagtcatatgagaaaaaaatttcagggccaaacacaaaaacaaaacccccctactatgcaaattggcagctgaaatgaagtggtattttctagaaaagtattaaactactgcaaaatgcaaacagatttccattcatctcattttaaatcactatttgttcatttcttgaaaacttgcttcatggaagggactgtaattataacagacaaatggcatattgtccttgacttctctgagcttacagattggtattgcttagtaagatgttgcggctaggcgtgctggctcatgcctataatcccagcactttgggaggccagggcgggtggattacaaggtcaggagttcgagaccatccttgctaacatggtgaaaccctatctctactaaaaatacaaaaaattatctgggcgtggtggcgggcgcctgtagtcccagctactcgggagcctgaggcgggagaatggcgtgaacccgggaggcggagcttgcagtgagccaagatcacaccactgcactccagcctgtgcgacagagtgagagacagagtgagcctctgtctcaaaaataataataataataataataatgttgcaatagctaaatcttcactttttcttttgtattcaggattgactggaaagtaaatgtcactcagtctgaggattcctccttcctgatatatatctatatctgtatctgtatatggacataacatatatatacatctctctattatctaatctgcatctatctatctatctatctatctatctattgatgcattccaagcttattcagttctagaaaatggaggagggatggaactcagtcctcagttcatactgatgtgacttctcctgggctccttgcttaggcatgtggggccaatttgatttggatgactccactggcagctggtttcactctaggacagctgggaaaattttgcttcatctcccaaaggtttactgcttagtactaattctttctcccttgcaggctgccagcaggcatccccttgtggtatcgtcacatcagaggctatgctatcaaatgggttcatatgtcttccaacctgtagaattgcaacccctgacttttctatgtatctggaagctcttagacaccccaagggatggagccacttctaacactgagacctcctcttctcctccatcttcaaacaaaaactctagctcagtagcctcatgggctgtagtcccagctactcaggaggctgaggcgggagaatggcatgaacccggactttgacctcccaatgcaaaggcccatttagcctctgggggagcccaccaagatagaacttcttttcaacttaatcactcaaaaaggctaacttcaaggacactgagattaccttcaatgttactttttgggagatgtgagaatgagaaacaatagctttcatttctcttcattgaagctaaatttgagaagaataagattaagttaaattctcaggagcttattctgccaccccgaattctccacaaagtccctcctgtacttaagaagagggagttttgtgctcgtttgttcaccattgaatccctaacattcagcaaacctcttggctcaggaggcctgatatatatttttgaaataatagtgaatgaatcaggcttaatgtttccagaagttagttaccatgactggatcagtcattgcttatatctgggaacactgaagagcattaattcacagataatcactgagtctatgtaccaggtgcttatctgggcacttggaatctgtcactgaacacaagggcaaagacccttgccttcatggagctttcattctagccaaggagacaataatcaatgaatttattgaaaaagtaagttatctagtatgctaggaaatagatattatgggaaaaagaagggttgagcagggtaagggagatacagagtaaggagcagtttgcattatgaagtaggtggttggcctcattagataagacagtgaacagagacttagaggtggaagggagtaaagtggaatttagggcaagagcactctctgggcagaggaaacagctacagcaaaggttggaagtctgcttggcatttttactttagtaaaatacacataacaaagtttacaattttaaccatttttagtgtacgattcattggcatttcgtaaattcacagtgtgcagacatgactactgcctagttccagaacatttttatcaccccaaaggagaacccatattcactaaatagtcacccccccattcccaccttcctcagactcccggaaattcctaatcttctttctacttctgtggatgtctttggcattttggggaggtgaagaggctcatgtgggctggagtctagtaagtgaaggggagtttcgtaggggagaaagtcagtgaagtaatgggggctgagccggatccctggtaagccactgtaagaactatgacttttactctgaacaaaatggagaacattccagagttttataccgaggggcaaaactctatgcaagagtaggtcgtatgtgtgagacagggtgagaggcagattgactaggaggttatcagtgtaatccaggtgagaggagataatggctcagaacagggtagcaagagtgagagtgctagaaggaattgaattttagtaagattttgaatctaggaccaagagaatttgctgtaggcttggatttgggatgagacagaaaggagttaaggattctccagttgttctaacgtgagcaactggaaggatgtagttgccattaactgagacagggaagctatggctggagcaggcttgcaggggaatatagggaatgctgttttgggcaggttgagtttgagatgtctggtcatctgaataaaggtgtcaagcagttagtgggatatgtctgtctggagttctagaaagagttctgttgtggagaaaaaacaacttgggagtcattagcatagagatggtatttaaagctatgagaatgggggaaatcgctgagggattgagtgtgaactgataatgagaagaggccacgtggtgagcactggggcatattctcctttagtggtgaggggcacagaaaaaaactataaaagaaagaattgaagtaggagaaaaatcatgggtgtgtagtgttttggaagccatgtaatgaaagtaaaccaaggaggagaggtcaactgaatgagatgctgctgaagtgatggacagttggctttagcagattgtggttggatcaaaagtcatatgggaatgggtttaagggaaaatgaaaagaggagaattgggaacagtgagtagggacaaatatttggaagactttctcataaaagctgaaaaaaatgagggcagtacccccttcttcggtgcctcaccttcactagaaagctccatatttcttaattattctaacaaataattatagttaattctggtgagtgatgcatttctttgcaaaatattgtctcagtttcttcctcacagtttctcaggatgctctttgtcatcatttaaaaagaataataaactaatgagcaagataaggagagaaaagaaacagatctgagagaagattctctttctggaacactaataataagcttaatattttacaaaataaaacacttttaaaaactatcctgtaaaggtcttatttatgtactttttataggttagcttataactgtttctataaaaactaagaaaatgtggaaaattttgaagtcatggggagaatatctgaatagcttttcctcctagtttcttggaaaaacaggaaattatatgcaagactcattttaaggcctttacagtgtttaatttacttaagtacataaaaatgtattatgtataacttattaaatgtattatgtataactaataaagtcgtgtctgggataattaaattttaaaaatatggtagattaagaaagcaattgcagatttactaattgaatttgctatttgatgtttttaattttttaaatcacaaatagggttctaaagttgttgcagtgaaatgaatttaacatttcttatatgctcaattaattgggaagcaggcaaacacctgaacaaccatcatactagtattgcacataaatagatcctgttttagctagttttatgctcgtatgacattaaaaaattttagagacaagttttctggaaaagtagctgtatcataaaggggagaaagcccttgaatgtattgaacatggtgggcatgaaacttggtggaattgttggcagtttttgaggtgtcactttccacagtctcttcaggcacattggttcatgtctcattccttctcgcatgctactctactatttcatttgatcattgttttacaatttccgaatgaaaatcagcttttttcatgcactacatgagagggaggaggctaaaatgcaataaatgatcttagaggattggtctgtaaaagtcttctcaccaaggctgtgggaaggaacgtttcctccaagaactatttggcttatttatctgctatgtgccaagtattatgctaaattctgtggtgcaaagatgagagctagattcattcattcagcgatttattcattcagtcaacatttatgcaaaatcatttggattattcaaaaaatatataaagacagtcattatcctgcaacaattgaaaatagagttaaagcttatttttgctttgtaatttaatcaaataaacaactatgctacttgctctaacttacttttctggctttttaagtcttgagttcaaactactttcagctggaatcttagggatacagttgaggacagtgctattataccagttttcccaaagctcataaaaaaatcctaattaatctttaacttatattctttacattttcatattttggtatatattttcttaaaacaagaaaaatttagtgaattcttaaataaaataatattttcataaaatctttcttcagtctgggtgtggtggctcacgcctgtaatcccaacactttgggaggctgaggtgggcagattgcttgaggtcaggaatttaagaccagcctggccaacatggtgaaaccctgtctctactcaaaatacaaaaaatagctgggtgtggtggcacgtgtctgtaatcccagctagtcgggaggctgaggtgtgagaatcgcttgagcctgggaagtggaggtttcaatgagctgagatcatgccactgcactccagcctgagcgacagagcaagactctgtctcaaaaaaaaaaaaaaaaaaaaacaaaaaaaaaactttctgaacagatctgttttttaagtgggtagttttacaggggagaggttatttcctaacgttccttcaagtgagcaaatctgtcagagtttgctgctccccacaggcacctaccattctacccccaaattaactctttcttatcaatgaaaggtatttccatttttttctgggagagaacaccaattaaatagttaggtaatttggtacctaatgtctttaacatttcttattaataccttatgaattataatattataatcttccttttaatgaataggttatactcccctgcaggtggaacacttagatgagaagttgtaaatatctttaaaataagggtttaattaattataaatatgcctgctaattttaggcaggattctactctaggaactggaaaagaaaccaagaaaataaatgtcttttcagctgtgaagtaaataaccatctagtgagagcaacagagtgagccccacattattcaggtggaattggattaaaaagctctgccagtgagataaaaacaatgggatcagtggtggactattgaaataggaaggaaaaccataccttatttagatatgatactcgtataaagatgttgaaatgcttttatttctctgcattgtcatatgattcaagttgggatgggcccatgtaagatagatgaagcagaagagcaaacagcattgggtttagaggcaacatctaaaacaatgtgattattttgcccctcacagaaattagtgtctcagtaaaagtaaatacatttcctgggcaaccagaaacatatgttgcatgttctttccagtacagtatgaatcctcagtaagacaaaaagagaatggttctcactaagcaaaccttccaacttttatgtccctgagccttcagttgctgttgttggttgttaacatctggctttccatcatcccacttttctcactcatagttgtgggcttactgtgggtattccttggtagtctatcaccaacatgagggcaagattagtagatcaaaatcttgtatgtttaccacttagctgagagccttacacatagtcactgctcaataaatattttttagcaaatgagttaccacgcaaatctcaaagcctttcttgtattaaattctagagtggtctttgaggaatcaccacactgtcttccacaatggttgaactaatttaaactcccaccgacagtgtaaaagcattcctttttctctgcaacctcaccagcatctgttgttttttgactttttagtaatagccattctgactggtgtgagatggtttctcattatggttttgatttgcatttctctaatgattagtgatgttcagcttttttttcatgtttgttgggcacatgtatgtcttcttttgaaaagtgtctgttcatgtcctttggcctctttttaatgggtttgtagaaataccatttgattcagcaatcccattactggatatatacccaaaggaatataaatcattctattataaaaatacatgcacatgtatggtcattgcagcactattcacaatagcaaaggcatggaatcaatctaaatgaccatcagtcatagattggatagagaaattatggtccatatacagcatggaataccatgcatctgtagaaaggagtgagatcatgtcctttgcagggacttggatggagctgaaagccattattctcagcaaactaatgcagagagagaaaattaaacaccgcatgttctcacttataagtgagagctgaatgatgagaacacatggacacactgggaggaaacagcacacactggggcctgttggagaagagtggtggggggagggagagcatcaggaagagtagctaatggattctgggcttaatacctaggcaatgagatgatctgtgcagcagaccaccatggtacacatttagctgtgtaacaaacctgtgcattgtgcacatgtacccctgaacttaatataaatattgaaggaaaaaaatacaaaaaaaattctagggtggactttggagaagatggagggcagggagattctaagaacaaatttttgtgacactctaaaaacaaatgaaagtgacattagtcattgagcttttgaattttttctggtaggactttacctgcaactaaagaaaaaagatggacaacctttaatcttgtatcacatcaatactgtcattaccttgtataaaatttccatttaatgcatgttctttaactatctgagtgataacaggtgaatgacatttttgtatatgcgtatgtggcttacatatttcccaattctgcaaactaccatgaagttagtattagaaacttactttgttatggttagatgagttaaaggagggaaattagatgcactgtatatacgtatgtccccgagagtgcactttccatgaatgatggcttgcatcttctcattttcctagatttttcacttctatcactatcatgcaaataattacaaatagcaaataattttaaatgtcagtaagctagtcttgagagcatgcagcatttactgtcatagagcaaaataaattaagtagaagatgaagtcttctgccttcatgaagttagcattcagtagagaagttgggacaaaaaaaatatgaaatatttgttgccatctacaagagaaatgtggaactacaaccatttgcagtgatcctcaagtcctgaagtggggcaggagtcaatgtggccactggttccaggaatggcctggagaactacaggcagattgtctgaaagcagagagcatatcaaccttctcctctcttcatgggtaacagatgcaccattaaaatgtgaacatcacacatgtaaatcttagactttaatgtttttataactgcaaaagtatagcttaattagacatatataatgaacctatcctatatgtaggatatatatcctacataccctaaggtgcatgaaacataggaatgacttcagaaatatcaaaattaggaatccttctctgttgccatgttttgaaggtaagatttttggagttgtatataattcattttttaacactttgaatgtattactttgtctcaagcctacttaacaccaaagcacattcataaaagcacttagctaattgtgaaagctagtaataactagggaatctgaacctgaaatcacatacttttttttttatttttgttgattattaaaagagaaattaagttatttgctcatgtttatattatggtaggtaaatttaactcccaaaccacaatcttacataggtagacttgcaccacgggactttgctgtacacattatttcatcacccaggtattaagcctagtccccattagctatttcttcgtgaccgtctccctcttccatcctccaccccagtgtgtgttgttcccctctatctgtccgtgtgttctcctcatttagctcccacttacaagtgagaacatacaataattggttttctgttcctgcattagtttgctaaggataatggcctccagctctatgttcctgcaaatgacatgaccttgttcttttttatgactgcatagtattccatggtatatatgaaccacattttcttatccagtctactgttgatgagcatttaggttgatcctgtgtctttgctgttgtgaatactactgcagtgagcatatgcatgcatgtgtctttataatagaacaatttatattcttttgggtatatacccagtaatgggattattgggttgaatggtatttctgtttttaggtatttgaggaattgccacactgttttccagagtggtcaaactaatttacactcctaccaatagtgtttaagcattcctttttctccaaaacgttgccaacacttgttattttttaactttttataatagccattcttaatggtatgagatggtatctcattgtggttttcattttcatttttctaatgatcagtgatactgagctttttttcatatgcttgttggccacatgtgtgtcttcttttgaaaagtgtctgttcatgtcctttgcccatgttttaatggaactgacaaaccacaatcttgattgcttaatacaataaaggattatttctcaccatgtcaccatccagtttgagttagtattcgtggtaaggggacaggtgttgggaacctttgctctgcccaatcttttaggaattccgatttcttccactgataggcttcactatcaaggaaggctgtggagtccccagtggatcctctgcatttggcctggaaacaagggaggaagaagtgtggaggattgtgttgaagggttcatttttcatccagaactggaggtgctagccatcacctctgaccacctttccttagccaaaatttaatcatgtcattccacttaacttaaaggagcctgggaaatgtaatctagccctttgctggggaggaaaagaaaacagagttttgaaacatgcagcactgcttctgccatagtgtttaaacatcatgcattgatgtaaaattttctggactttcaatatacatcaaaagtttccagcttaacacaaagtcaaatgaaaaaggaatggccaaaaacataacaaacaagaaggaaggcatatcaaataaattggtgaatttggaagcacctattttaaaagaaatggctgtccaaagacagttctagtggaaatgaaaggcaagtaactctatttcaaatcttggactaaatggaatagtgtaaagagttacctatctaggaatcctcattaagtagccatacacccttggactattcacttatcttctctaagacttgattgccttgtatgaatagtggacataatgctaatatatgttttcatgcttgctttgaagcaaacaattatatatatgagggtgtttgtgaaatattaattgctaaacaagttttctttcaggctagttgcattaaggaaaaattacttccaagaccacctgtaatattcacctatgactcatgaatttccagttggctagagtagcatagaaaggctttcagatttgtaaaatcaaggtttatctgaggtaacctttgctgcttgttggaagtatgtagctgagtaattgttcaaaaatagcaggttattttgaggtagaacatatgttctttaacaaataaaataagtgttctgaagggaaattttatagcatatttaatcacacacttaaaataatttaaatctggcagtttagagcactgtgtactttgatatgattttttaagtgctttattaagtgcagtaatactaaggtgagtactattgtgtggatttgcattttatgagtagctcttttcaacttctgtaaagaaaaaccatgtcatgaataaccaaaactgaaaaatgtagactaaacattttttatatttgatatgttttataaaattatgaatatatgctttttatatacacacatatacatatataaattataggtatgataaaagtgacttgtttcataagtcaaacaagcaaagaacccttttttatttatatcaacctgttaatgcatgcctcttggttgttggatgtattcatttaatagacatttaaagactaagttgttgttggtagtagggagcccagtaggtgttttcaggatattaacaaaaagcagccataacttccagcacagagctaaacacatagctgatattcatacacaagaaaaataaaatgtagtcaagccagtattttggaattggtcaggagacagataagtggtataaatatggcagagtgagattctttttaggttggagagccgggcaagacaacatcatgaggaaggaagtttttcattgattcttggagaatgggaaaaatttagtcatgtgacagccataagtcagacagggagcatggtatgagcaagacaaagggaggagctgtttgatttgcctggagaattaaataagtacaagaatattggaaaattattcagctcggaaacataggttgtggccagactgtggataaccttaaaagcccacagctttatggatagttttgatgatgtgacattgatgagttttcttttctttttctttcctttttttttttttttttttggagatggagtctcgccctgttgcccaggcgggcgcgcggtgacgtgatttcggctcactgcaccctctgcctccaggtttcaagcaactctcctgcctcagcctcctaggtagctgggattacaggcacgcaccatcacgcccagctaatttttgtattttgggtagagacggggtttcaccatgttggccaggatggtctcgatctcttgacgtcgtgatctgcccgcctcggcctcccaaagtgttgggattataggtgtgagccaccatgcctggcccaacattgatgagttttcacaactcatcatgtgatgtgattaaggaagcattgaaagcacagtttaaaaagccttaattgctgagatgatttcatgattattgttgtttctttagaaaccttgacatctcagcatatctaggacttttcttctctcaatatcttgaagagctaatttcgtttgcccccgtttttaggtttccacttcctatttttatgttgcgtatctgagattattatacaatgccccgtattttagggttcctacaaaagatagtaatgctgttgcttaagcagaaagtaatattgattctgactacgtggaaagtggggtggtaggtgaagtgaggaacacacaaagatataaaaccatgatgttataataataataatactgcataacatttggggaatagcaaataaataggatagaaaatacaattctgtaggagtttggagctgtgattggattttagaggagctagatggaagagttgaaaggacctctaactccaaaactgagtaatgaaattgatggtgtattatcaaggagcttcaggtaaatcatgcagccaatgaagagccttttctacctctccaactagtgtttctgtggcattgctttagcataattcattgtcatcagtaatgggaacaatcataaggaatttttgaagctgaatcttttaaaaagtaattgtgttaataaaaattttagttgctttatagtttttgcaacagataatggtggaatgtttaggaactgtggtgggtatattttctgtttcttaaaagttgaacaattccgttcttttattttctagttccattgctctcttatttgaacaggattttaagtttgtttaaaatacataaatgtggctgggcacaggggctcatgcatgtaatcccagcactttgggagggcaaggtagggggattgcttgagcccgagagtttgagaccagactgggcaacatagtaaggccacatctctacaaaaagtaaaaaaaaataaccaggcatggtggtgcatatctgaggtcccagctacttgggaaactgaggtgggaggattgcttgagcctgggaggttgaagctagagtgaaccgtgattataccactgcacaccagcctgggtgacagagtgagaccctgtctcaaattgtgtatgtgtgtgtgtgtgcatgtatgtgtgtgtgtgtgtgtgtgtgtgtgtataaatatataaatgtaacaaaacaaaaataagagaagaaaacattgggtcaggtgtggtggttcacacctgtaattccagcactttaggaggcctaagtgggtggattgcttgagctcaggaggaggatcgcttgagctcaggaggtggaggtcgcaataagctgtgattgcgctactgcactccagcctggatgacacaatgagaccaccctgtctctctgactctctctctctctctctctctctgtctctcccacacacacacacacacacacacacacacacacacaaaaagaaaaaaagaaaaagtagcataaattaaagatgaagttctacatagaatccaggtgctaaggtactatccattttgtataaataaatgacccacatacttgtctcttgagttttctgttagccacacaaaagagtgaacggtaggaggtttataagattggcactgtctgtagtataaaaacaaaccagctactcagaaagagcacaacccttcctaataccaactctaggcagaaataaatcttttctgtaggttctctgagagaagccccatagaatgtaatgagtaatgaatatccttaaaaacatccttacaagtagatagagaaaacttgttttagtactttaaaaatacatgtttataatgctttgggttaattgcataatgcctaagcatcatccagaaaaaacttttacagaggtcaaaaaaatgtgcactagacacaaactgtaagggagggacttagagccgggccagtcagtgtcagttcacactgcagcatcatctgtggcctcgttagaaaggcagactctccaaccccatctcagacccactgaatcataaccttcaaggcactgttgagaagcacatattaaagtatctaagttgacttaaaagacagttagataagccttcatgaatcatatttcccttaactgagtttagataaacattatggagcagtaaatttggagatttttctttgtgaaaaggaaatgaaataaatataaattcttttactggttaagcgtagatctattgcttttgcctttacccaaacattgggaagggtgttagacattcagttactatctaatatgggtgaagcactgggttaaatgagagatgtaaagatgaacaagacagacatggtaactgtttcttttatttattttttatttcagtaggcttttggggaaccggtggtgtttggttaaacgaatactgttctttagtggtgatttctgagattttgttgcatccattaccccaagcaatgtacactgtacccagtgtgtagtcttttgtcccttaccccagtcccaccctttttcccaagtccccagagtccattagcaggggcaatttagttgtaaacaagttgagggaaggaaactgcaaggtataaacaaagtgctgtgatggttatttctattctctagattttatacagaagaagaaactagctcagagaaataacttggtttagattacacagctaatatgttacaaagttaagaattgaactcaaggtctatgtgatactaaattcagtttacacttctgaaatatagcttcttgaaagaaaagaaagggaaaactattcagaaagtgagaaaaatcatactataaatcagtagcttctctattcaactccagtattttagacaatgtaataattttgaattacatctcctggagcaagtgctgtttttagttaatataaactgaggtgactcttgcagttttcctcaggaggtaataataaagtagggattcttcttctcctttttttttttttttttttttttttttttttttttttaaacagggtctcactctgtcgtccaggctggagtgcagtggcatgatcttggctccctgcaacctccgcctcctgggttcaagcacttctcctgcctcagcctccccagtagctgggattacagacatgcgccaccatgcccagctaatttttgtatttttagtagagatggggtttcaccatgttggccaggctggcttgaactcctggcctcaagtgatccacctgccttggcctcccaaagtgctgggattacaggtgtgagtcacagtgcccagccaagggattaaattttgccaaaataaacagtgccatgattgcagtcccctgccaccccccaataaaagtaagattttattgatatatgaagacaagcctgttttttcttttttgaaacaggatcttgctctttcccccaggctagagtgcagtggtgcagtctcagctcacagcaacctctgcctcccaggctccagagatcctcccacctcagcctcctgagtagctgggactacaggtgtgcaccatcatgcctggctaatttttagtatttttttgtagagatagaatctcaccatgttacccagactggtttcaaattgctggactcaagggattcacctacctcagcctcccaaagtactgagattacaggcgtgagccatcatgcccggccaacaagccagttttatcctcaagtgttgtgtgaggattcatgaagtgtttagcacacagcaggttttcaataaatattgattgaggaaaagaatttaatatttaccctttagatcacctttcgagcccacttttattgggtaataaaagagtagaatgaaaggaatatatttagaattttaaaaatcttacctcttttagaaacattttatagtataccagtcgtcatgacaatatgtgaactccccatcactatgtacttcatacttcagttggcattggccacagtttcccccatatcatactgatatgtatatttgtcttatattcccacaatagtatgagccttttagagagatctttatatttttctttcctatatgggctactgttaggtgtgtgtactcagaagatggtcattaagtatttaaatgaagaatgaatgatgatcactacaattattttaagtcaaatctgatctagcaacctgtgcctttatagtgagttcccaatggctgccttttaaacctggtcaaagccttgctagtcaaagatgatctatgaccatgcttctgagtatttttagtattgctgttgagagggctagcatttacggggtgctaattctgtgacagacacttttttttgtttttttttttgttttttttttttttgagatggagtgaactctgtcgcccaggctggagtgcagtggcacgatctcagctcactgcaagctccaccacctggattcatgccattctcctgcctcagccttccgagtagctgggactacaggcgcccgccaccatgcccagctaattttttgtgttttttagtagagacggggtttcaccgtgttagccaggatggtctcgatctcctgacctcatgatctgcccgcctcagcctcccaaagtgccgggattgcaggcatgagccaccgcgcccggccaacagacactatttaaaacattatttcctttagtcagtacaacagtcctaggaactcttactgtctgtagtggagatagggaaacaggtttataaggaattaataatttattgctcaagagtaagagtaaatgaataactaggagataatgaatgtcctggccatttattctcaaagagcatgaatatacagaataggctgatttgagacattatactgctttcttcctggaaactgactttggtggaatggtcaagctcttactttagaagtcataaagagctgtgtatggagaaggtaacagtcggtatgttaaaacaacagatccggccatagaataggtgcctaatggttctgaaatataagcaaacatgctggacaactttatcattatttctggcatggctggctctggggctcatgtttgtaatcccaactctctgggaggccgaggcagggagattgcttgagcctaggagtttgagaccagcccgggcaacataacgaaaccatgtctttacaaaaaattaaaaaaaaaaattgggtgtgcatggtgatgcaggcctatagtcccagcagctcaggaggttgaggtgagaggattggttgagcctggaagttcgaggttgcagtgagccatgatcatgtcactgcactccagcctgtgtggcagagcaagaccctgtctccaaaataaaaaataaaataaaataaaacatagttgtttctgacttagcagaatgtgttatattggaaactctatgcttctgtgaatccagtactgcaactctctcccactcatttaagaataaatccttaagaatcccaagaaataaacatataccacagttcagtccattgggccagtatatttataggatagtcacacaagtccagaaactgtcaggctgttactctgtgagaataatgggaagggttcttatcttcattcccactccaaagtaaggtttactttctagaagtgagatgcaatataaagtacccacgcaaaaggtttgaggcttatgcagaaaacaagcatggattaggatagttagggtttcatggagcatactttttccattaacaccaagaagataaatttagttgtctttttctgctagagctttgtggaatggagttagtgaagtaaaaggcatattccctttgtttttgttgcagaaataaatgggcaaggacactttaaagatttcgtgtgtgcattgtggctacttgtcctaaacataaaatcatacaactaaatgaaaatctctctttcaattcattttaacatagtgatttgctgcttattagtgcaatctggcaaaaaatgttagccaagcagctaatattttgtttacatttttgccctagcaaagatatatcaaatcccctgatgtacacctcttactcaggtattattgtaaaaatcaacaaggaccatttgaacactgataatactaaaaactgtcggttcccttattgtttctttaaaaataaaaccaaaacaaagcaattaactgcaaagggctatagtaacccaaagcaaagtttacatatttaaacataggggagtaaggaagtacagaagttaaacaacaagagagataatcttgaaagtggcaaaagtgacttatctcacttaaaagagtctcaataaggctgacagctgatttctcttcagagaccatggaggttagaagacagtggcatgacatattcaaagtgatgaaggaaaggctatcaagcaaaagttctatctgtagaaaaactcctccaatttttaaggagaaattaaggcatttccagataaacataacctgagagaattttccactagtagacctgttctacaagaaataccaatggaagtccttcaggctgaaataaaagggtattagatcacaattcaaatccacatgaagaaataacactaataaggtaactgcataggtaaatataaaagacagtataactgtatttttgtttgtaacattttttcttctgtctgatttaaaatacaatgacattaaagcaataacgataaaactatgtgtttggctaatagtgtattcagaagtaatttgtgtaacaataacacaaagaagagggtagagaacagagctatttagaagcaagattttatatactattgaaattaacttggtattaattctacctacattgttataaattgagataatattaatcaccagggattaagaaaacaactaaaatgcatactaatagaaataacaagggaattaaaatgatacattataaaatacagattttttataaaagaaggcaataatagagaaagagaggacaaaaagacagcatatagaaaacaaataacaaaatggtagacataaatcctaccttatgagtaatttatttaatgtaaatgtattaaatagtccaataaaaaaagcagatgttgaaagaatggataagaaaatattatctatttgtattctctatgtaagagacacatatgagattcagagacacaaattagtaaaagaatgtagaaagtaaaagaatggaggaagatatgccatgcaaacagtgactgaaagagagctgactacactaatatcagtatgttgtgtgtcagacccaatagattttttttaaataataaaaccgcatttttatgttacaagaagattttatataatatctgcatgatataccaattttctcataatctcttctgtaatattatttcattaacactctggtccacagcttgattcaacaagatcaggagggcaggcaggaggatgttaaaagaaaggtactgaggtgtaaaaggaaccaaacatttactgactcaggcacctattcttgatttctgttcacctgttgccttgaacaaactgcctgagctcatatgccttacctccataaggagcatgacctttgggaatttaccaggtcctcatccctgtggactcagaatcttgcttggtaagagtttataattgactttttttttttttgagaccgagtcttgctctgtcacctaggctggagtgcagtggtgtgatctcagctcactgcaacctccacctcccaagccccagcaattctcatgccccagcctcccaagtagctgtaactacagacatgtgccatcacacctggctaatttttgtaatttttctgtttttaagtagagatggggtttcgccatgttcaccagtctggtcttgaacccctggcctgaagtgattgacctgtctcagtctcccaaagtgctgggattacaggtgtaagccaccacgtgggcctggctgacacaatagattttaaaggacaataattttactacagacaaaaaaggacatgttgcaatgataaaaggctcaaaccatgaagaagacataggaattgtaaacatttatgcacccaaaatgtatgacacaaaattgacagaataaaatggagaaatagaaaatttaacaataatagttggggacttcactactccactttacataatggacagaacatccacaaggaaatagaagacatgaacaacactgaaaactaggcctaataggcatttccacccaacaacagtggaatacatattcttctcagtgctcaaggactattccaggctaagccatatttgctaggccataaaataagtttcaggaaaatttaaaggaccaacagcatgcaaagtatattctccaactacaatggaatgaaattagaaattaaaaaaaataagaatttagtaaattctcaaatatatgggaattaaacaatatactcccaaataaccaataggtcaaagaacaaagcagggtaaacatacatgtatatccatattaatgaattaatttaaagaatttttagtcacattatggcttaaaaataatttttcagtattgtccaaataaagtacctcattgccatgatgaaattggatacgggagatgttagcttgctaaaaatgacatataattattatgtaagagggacattaaaaggctaacaattaattttgaaggattaacattcttattttagaaaggatgactcctgttaagacattcttgcctatgcatacctgctgtttggattttctttctaatggaatagactagtttatattactatctatcttattgacatctcaaagcccttggtttaaattgatggttcagttagacaaaatcttaacttacaaggaaaagttgtttatgcaagtgaatttagaaatttagctatctatacttttaaaaacattggcagtatatctcagtggtatgagatagtccacatctttttatggactttttgttttattataggctttagtgccattaagggaaaactatttagttactctaggaatagccaaacattgttcccagaaatgcttgtgttatgtctgtcatggtacattgttaagttcagagcacatgtgtttaggagtctcaatgctggctgaagaatggaaaggacttttattacaaatagtggattttatttaattttgaatttatattaaatgatgaaaaaataggtcctgcaataatttagagaaaacctgtctcttcagggcaaggacaaatcaatattgagtgtttcaattgaattgatgcactttcaattataataatcttcatggtagttgaaaggcaggcccaagcaaaaatcatgatatgcacaaaaatattgctggaagcactatctgctattagctatctgctcatgctgtttaccttcacggaatttctaggttcaaaatcagccatttatttagaacgccagagtacccaccaaggaagcatattgtatagttttgttctgacgaagcatgtggctagaaaacaccagaaattagagttggggttacaaagagtctatgcacatttcttaagtctgagaggtttttttccttatgataattcagtagattcctataaatgactctttagtcacaagtttttttcatttagaagaaaattaaaggtatttaaataaataaataaataacatgcccattacatgttaacatgagaaacttttttaatgaaagataaacatattttcgaaaaaaatttaggagagtagcagtgtttgcattgttgcaaatagctttgatatttaacttaatacaagacagctggattttcatatctgcttctgcatgcaatctgtagcaatatgtgtttcaggttgagaatatgtggaaaatttggccttccacagataatattgctcaaagaggaagaagtattttaagaatctttgcagacaattatggagattattctataataccacaccgaaacttcaaaagtagtagttttctaaaggttggtcgcaatgtagaagctgacaccatatcaataatttttaatactcttattacattaaaatttgttggtctatcttgcactttgaatgggctttttaaccatgcttgatattgcatcactcactggtcatttggaaaaaatgtgtgtcactaaattatacagattttccaaatgctgacacacttcattgtacattatctaacaaaacactttcattaattacaccatttatctcattagaaaattctaagtattgacaagatatcatggtggccaacgcacaatttcaaaaatttaaagttttccttgaaagttctaattttattagcaacaattactctcagttattttccttaccgtgacaggcactttgggttcatttttgataagttataggccaaatactcaggtctgaataatcagttaattgaatcattcaagtaaaaatgttttttctgtttttaagaaaacagctagtttggcttgcaactcaaacaattgcacaagtacctttcctcaggacagacattgtgcatctgtatgcagcaggaaggctttatgtgcacgtcccatctcatcacacagaatattaaaaagatgcatgcccaacagttgacattcaataaaattaattttttcctgtttcatcaagaatattagtaaataaaatatatgttgtaggttttttcctaaaggtgggggtacagttttaagggatacaatgactgtaaatacactgtgataccactgccttgattgttgataattgacagcagcagttttacctgccatcacttctgtaccatcggtgcaaatatcaacacagtgagaaaacatataacatcttagtcttcttatgaaagtcattttgatgcccaagagcccatgtgccatgctttttgagaactagtgctttatttatatttatgatggagccatccaattttagagatgcaaaaacattaggtacataggttttaagaattttcaaactgagaaaaaaaaattacaaaaatcacatatttaggttttaacctgacttctgtgctgttcagctgtgaaaataaaaccatgttattaatataaattgtgaggggaccagtctacagcttctgtactccaaagtacattttgctaaatcaaggtcatatctaaaagacatggctttattatgatagtgtagtttagaaacattaaaacttatttctaaatttattttaattgactttataatgtataatatgttgttttgaaacatgtatacattgtggtgcagctaagttgagataattaatttatgcattatctttcatactactttttttgtggcgagaacacttaggaatatttctcttgcaatattcaatactacaatgcatttttattagctatagtcaccatgacgtacaatagatctcttgaacttattcctcctatctaaccgaaactttatatcttttgaccaagagctccccagtctcttccccacaacactgttattagtacctacccttctactctctacttctatgagagtaatttttatagaattctacctataagtgagatcatgcagtatttgtctttctgtgcctggctgatttcactgaacgtaatgccatctagttttgtccatgttgttgaaaatgacaggatttccttttatttgttaaggctgaaaggtattccgtgtatatgtatacatcacattttctttattctttctttattgatggacacttagtttcatttcatactttggctgttgtgaataatgctgcagtgaacatggcagtgcagatatctctttgacatatttacttcatttccttttgatacatacccagtagtgggattgctagatctcgactggaaatattttgtgcttctgcttctgtccttacatagctgtttatgatagacaataaatattaggcagatacctaaacactcttaaaataccaacaaaaaaacctgtgacaccattcttatagtatttccaattttactctttctttacatagtacttgatagaatgctgagcaccctgacttaacacaatcttaattgatgttggtgctactcagttattggaataatttaaaatgtgcctttcttgatcaattagtattttcattacagctcacttatttaattgatctaatgaaacactaagcctattagaatgtgaagaaatcaaagagaaatgtagaaaatattttataaaattcatctaacatatccactgtgctgtgtattttgcagctattttcaaaaagtttatgtccatgtccatgttttattgacacacatacagtcgatacatacattgcttgagatgatagtttctttgatggctatatcttatttctcatatacctgtaatatttagcacatagaatttgcatgaccaaagtttgttattagtttgaattttaaattttactttatgggcataagtttatgaactcatttccagctgagtttaagagttttcaagtgccagagaggttgcaagaaccaaattaaaaaaaaaaaagttgttgctgaaaattctctcttaggctcaagagcctcaattttcaaatgtggttgattttaattaaagtttaaagagaaaaagaaactattggaaagatattggaactaaataattcacttgtagtgaatagggagtttgtggtttgagttaatagtattcattacactgattaaaggcagtgagccattttgcccttgtttattttccaagccagtgtttccagtaatggggggtggctggtatttgatgttttatgtaatgaggtatttactgatgggctactttgacttctctacttaaatggataaccacttgaaaggaactgatcagaagaacagtttcttttctagagctggaccatttattccaaactcagacagtaagaaaacaattgaatagcttttattgccaccagctgtgctgtggttatttgaacaaatggaagactaaagtaatggtacaatctcattttatacagcattacacaaaatcaggattcttttgcctaataaatattgcatttatagttacttagatttccatcattatgatgagtttgctgccctttgagggttaataagtgggtctatcaaagttaagtcttctggaagttcagggaatgtgctgcttcagggcttatagcaaattcatgattatttgttttgcagatatacacacatatatacatacacatatatggaatatgtaacgtggaatatatataaataaaactctaaactttgaa

SEQ ID NO: 2002 - DNA, 361619 bp, Homo sapiens
ggagaatcgtgtattaggagagaaattttctattcttatcaccaattacaagatgccaagaaaagcttattcaataaaatatgtggtgcaattgtgagattcccttcattgcaggtgagaatattcttccaacagagttgaggtcaaattctcccagcagttaccgggtgactctgtcattgtgagcacaatgtaagtaagcaagaagttgggttttccaggccctacagtatgcatctgaatagcactcatcacacggtttgggggaaccagtctcttcctctttactagaggtgtaactagggcaggttattgaaactctgctaacctcagttttctcactgataaatgtcctaataagctcagactactataacagaataccacatactttgtggcttaaacaagagaaatttattttctcacagttctggaggctggatgtccaaaataatgggtgctggctgattcagcttgtggtgagggctctcctcctagcttgcagaccgccaccttcccattgtatcctcacatatggtgaagagggagggagctctggtctctgttcctcttcttacagggatgttaatcccattatagagacccccactctcatgacctcatctaactttatcagcctcccaaaggcctcaccacgcaaataccatcacattgggggtaagtgcttcaacatatgaatttggggggaacacaaatattgagtccataacaatacagtagggatgatgacactgttgttggcttctgttgtttttgtctgctcagcatccctttccttgagaagcagccatgcaccatctggtgctggggagaggcactgccaatgccacaagtcccacctctctggtcatggagggggccatgaaattcaggcccagccagtgatagtgacctatccttttagcctcagagtcaggctcaaggttgtgaatgtgactcaaataaggtcaatcaatccttctctggggtcttatttacagatgatgagcgagaccctgactctttcctaggcccatgagctaaaaaaaactatgggcagccatggtctccattgcacaggagagatcttgtctgtaacaggaaagaataaaccaaaaagagctgagaataaggggatcagggagagaggaaggggcccgtaacagtggaggagacacccacccttgtcatccctgaggttaacttcacccttagacttccctgtgatgcttctttagcattccttttcattggcattagttttggttgtgttttcatcgattggaacttaaaaagttctggctaaataaaatattgactttatagagttgtgaaaattaaattttgtattatgttaagggcttcattatcagagcctctggaaaatggaaagtacttaataacttatggctaattgtattggtggcccttctctctgtttttctggaacctggttagtaaacggtggtccctgtggtccagtggcattggcatctcccaggagccaattagaaatgctgaatctcagacctcacctaaaatctgctcaatcagaatacgcatttggcaatgtccatgcatgaattgtatgcacataaagtataaaaagtactggcctaacaccaaaagcacaggcaagaaaaataaaaatagacaaattagactccatcaaaatttaaaacttctgtgcatcaaagtgcatagagtgaaaggaaaatcatgtatctgacaaggcgttaaaatccagaatatataaggaatgtctacaactcaacagcagcaaaacccaagtaacccaattaaaaatgggcaaaggacttgaatttctccaaagatgatataaaaatggcaataaacacaggaaaaaatgctccacatcactaatcactaggggaatgcaaatcaaaaccacaatgagatattgcctataaccattaggatggctatgaacacacacacacacacacacacacacacacacactagcaagtgttggtatagatatggagaaattgaaatgcttgtgcagtgttggtggaaatgttaaatggtgcagctgctatggaaaatgtatgaggtttcccctaaaaattaaaaataaaattaccatataatctagcaattccacttctggatatataatgaatataattgaaaacaggatgtcagtgagatatgtgcttgcccatgttcatagcagcaatattccaagtagccaagaggtgaaagcaatgccagtgtccactgatggatgcatggataaacaagatgtggtatatccatacaatgaaatattgtttagccttaaaaaggaggaaaattctaatacatcctacaacattaataaaccttgaggacattatactaagttaaataagccagtcataaacagacaaatactatataagttcacttatgtggggtatctaaggtagtcgaattcataaaaccagaaagtagaatggggctgtgggggtggtgatgggggaatggggagttgttcaatgggcaaagagttttagtcttgcaagatgagaagttctggggatttgtctcacaacaatgtgaatatacttaacatgactgaattgtgcacttggaaatggttaacactgtaaattatgttatgtacgttttactaaataaaaaagaaataagacgggctgggcgcgatggctcacgcctgtaatcccagcactttgggaggctgatgtgggtggatcatgaggtcaggagatcaagaccatcctggctaacatagtgaaaccctgtctctactaaaagtacaaaaaattagttgggcgtggtggcatgcacttatagtcccagctactcaggaggctgaagcaggagaatcacttgaacccaggaggcggaggttgcagtgagccaagattgtgccactgcactccagcctgggtgacagagcgagactccgtctcaacaaaaaaaaaaaaaaagaaaggaagaaagaaagaaataagacaaatgtaaacaaaacaagaaaaacactgacctgctacactggggttctttgatagaaaagtctgaaaatatgagatgttacaagtggatggcttcctaattccaagtagaaacactcagatgtgtaccgtggaagtcagaaagtcaatgagataaacagacttcacaaacaagtttaaaaagagttggtggcgtgaatgtcactggcgaagattttacaactagcagtcttcgtctgtcgcctggctttcacagaacttaaaaaaagcctcataatttaagtttgacttgtctcttcgatcactgttaccgtgttctttatagtaaatgtagtcaggattcttttgtaccctaactagggcaagtttgtttttggaataaatgcagccctcaaaatacagaagaactctgttccagaaaaatttatttctaggtcagttgaatacaagtttgaactcatttgtagttgaaaacaacgctagaaatagtctttaagttattagatgtgtacacaaatcttacaacataaaagtgcttaagatgaatttcactcacagccagtgaccacttctaacagcagaactttttgcagttcggagaaggagacctgagacacatttacccttcctcaaccacccagaggggattgtttgttaggaggctgccaaggtatagcccagggggttggagatgacctgatgtcatgctgcctccagcacagttggattttggtccttggcttttccctagtgtcattaaacacatcccctaagaaaaatgctcactctttggcctttggtcatcactgatgagttctagatctctctatcagaagtctacaggcatcataattagctagaaagggttctaagcctaagactcctccctctttctaggattctgttcaatgcagtgtagccatgaagattctctctttcaaaagagacctcactattctgtcaatggctgggcaagtgcccaaagcctacccaaatggaaggcttctgagaagcctgggtggagaacacagatttgcccagtgctcagagcttctgtgggaggctgaataatgcctccccgaagatagccatgtcctaatccctgaaatctgtgaatgttaccttgtggcataaaaaaaggatctttacagatgtaattaagaatcttgagatgggcagagtctcctggatgaccaagtgagtcctagtcctaagtacaatcacatgtactctttgtaacagggaggcagagggagatttggtaacactcagaggagaaggtgacttgaagggagagcaaagagaggttggaagactctggccttgaagacaagagattagaagatagcatccccacaagtcaagggatgatggcagccaccaaagggtttcctgttgacacctcgattatagtccagtgattctaatttctggcctccagaactgtgggagaatgaactgcgattgcctgaaggcagcaagtttgtggtcatttgttatagcagccacaggacatgaatacagcccccatctgccacctgcatccatccttggcactctggtgcatgtgctccgagccaagtattacccacgtggctggctgcaaggagacagaaagcaaggacaggctgtgatacctgagcaggaagaaggacaacagggaaacagaagacctattgcactgatgagaaggagaagggagagacctgcctttacagcacaatgtattaaaatatgacaccatgaattccaggtttccacaccgtctcccttcagggagaaggagcagaatagtaacaaggaattgaaatcttgtgtaccagacgatcccatcactgcctttaccacctcccatggacacattatggacaaagggagcttggggcacaaatagtcctcctttctcaagctttatcttgtcctaaattgatctcattatctcccttgttctgtctctacccctctcaacttatgctgccttccgtgcccccactttagtttatagcatcatcatcatctgccctatatgtacccaagagaagtgggaccaccctgactccccttttttccatcctgccccatatctcattagaaatgtaagccctttgtattatccactgaacatatttcattgataatttttcctttttcattctcattgtcagtccctaattgaagtcctctttcacaggagcttcaccatatcccagtccgatcccactacttccctgatggaaacccttcagtgggctcctggcatgtttcccagaaggtcccagatctctggcatcactctctgtggtttgaacttgctttctttcaagattcacctgtaattttattctgcttttcactataaactgtagactatagttacacttaagatgttaccatttcctgaccatgccacgcgatttcatgacaccaagtctattctccttggcataatgtaccatggcttccccagcagaactgggggcaatgaaggaatgaagccctacatcagtgctttcctttaagactgcagggaagaaacatggagaacaggcatccaaaagggcaggtcaccccggtggccatacgttgccctcagtaacttcagccccagagtccccagcaagtctcaaaatcaacacatttggccgggcgcggtggctcacgcctgtaatcccagcactttgggaggccgaggtgggcggatcacgaggtcaggagatcgagaccatcctggctaacacggtgaaaccccgtctctactaaaaatacaaaaaattagccaggcgaggtggcgggagcctgtagtcccagctactcgggaggctgaggcaggagaatggcgtgaacccaggaggcggagcttgcagtgagccgagattgcgccactgcactccagcctgggcgacagcgagactccgtctcaaaaaaaaaaaaaaaaaaaaaaaaaaaaaaaaaatcaacacatttgctccaagaggctccaggtgatggcttaaacatctgattcaccttatctttttcttccagaatgtatacattcatcccttgtttaaagaagtttggtttactttttttctttaatctacctgagtttagaagatgccagtctttgcatttagtaattgttttgcagcaagttaaagaaagcaacacttccactccaagtctataccaccacctccttgtgctcctcttccctgagtgtgagtttctgcagagaaggccctcaaatcccccaccccagcaccaatgcttagtgcttccttccctgctggagtgtgtgcaggtgggtaaggactttgcttgatggtatagtagatatcttagaacacagttcattcctctgtcaaaatgagtctgctgatatacagctgttgattaaatacccaagctttgaattgcctaagcattttcccagaggttttagcctggaagtcactaagttgcctgtgagagtcaagattacattttcccccgataccagaagaaacgaaagctcatgagttgttgagtgcagctatggagaaatagaatgtcacctctctgtacaggtaaacttctttaacctcctaacatcccattgggcagaagtcatgtctgtcccctgagaagggatcagcttctctcccacatggatcacactttaggtcaactttcggacccaggtctacactcttacttcttggaaagcaggttgttttatccaaagtgttcttcatgcgccgtagcgacttctgcaagaaaagtctatgtacgtggtaggggctacagtccatcccacgcatgccccatggaagaaaacccttctgcatcctgcttttctgctgctgggtgattggaattcatcactggctgtctccagttcagaggtggcccacaattgtagcagtccccgttaatggataatataggatgttttgcatactttggccaaatatggttgtcattttaatgtatgaaccgacacagtctaagatttaggtctttcctgaacttcattctggccctatcattttatgcacattctgtaaatgcgggggaggagacaatgataaggaaaaagcatggaacttcacaactacaagctctgaaagggtctgctctacagaggatcatcagacattcctggtacatatcctatttggatcacactgtgcaaccagtcctaggtcaggtggcagaaagggttgcctgccctctttatgaggagaggaatctacttcttaacctgcttgctgaactcttcagtgacctcacctctgacagcaaagtcatggagatctttctggccaggtttgtaaaagttaggtagctagcacggcagctctgagaaaacatgagagtgtgtcctgcatccactttttgggctctgtagcaaatttgggtgctgcctaagggaatgaaacaacctccctatgtataacctgatctctctaattgtaccttaatttgcttatgcagaaaatcactggaattagagccacacatcctgctcattctgactagtacttcatccagccaagtccagtaactatgggaagggaaagcagctgagggtcactctctttcggaaaggttttcatctgcttgcaaacccacccacacctctgccttcactcctgtaatcaaagatgcagatctttcttagggcaattaggtctattcatctcctatttctattttcagtgtgcctctccccgcaacacccaaacactcaggtcagttcttccacccatgaaagcataatgaatacttacctacctgctctgggcacctctggaatttcagcaagcaagtatttgataagcaaagactagtttcctgttaattatactcagaaatatgactcatacaaaagaagcacaaaactaattggaaaaagaaataaaattaggcctgagaaagtaagaaagtgaaatcatgcaatggtaatgggagaaaaaaatatccatgatgataagactgaattaatagcttagatgagtgtgtgtcgggggagcagggagggatgatacacccaggaagtgatcatagagggtggagatttgcactgacatatgagtcatgaccaaatggaacaataagttttgttttatgagataaaatgtccagccaatttagtccaccatttaattggttttactgatttttttttcatggagttgactcatggttgtcttcttcgttttccctattaaattcctcctccctattaaattgtctggtttgcattaagatgataactgccccactcttaaagatgattggaaaactggtacagaggagagaaatccgtcctggaaataagacagaattttctaaagtaggatgatggagggcctttctgtaccataaacaaagaagggaaggaggccccgcacggtggctcacgcctgtaatcccagcactttgggaggctgagggaggtggatcacctgaggtcaggagttcaagaccagcttcgccaatacagcaaaaccccgtctctactaaaagtacagaaattagctgggtgtggtgggtgcctgtaatcccagctactcaggaggctgaggcaggagaatcacttgaacccaggaggcggaggttgcagtgagccaagatcatgtcactgcactccagcctggatgacaagagcgagactccatctagaagaagaagaagaggaagaagaaggagaaggaggaggaggaggtggtggtggaggaggaggaggaggaggaaaggtaacagagatgttgagggcatttataaactgatgagtttgggtgctccttggattgaaagattcctaaatcagctaatccctttctcctcagaattatgtctttctgtatagcagtctgtcctccaagttgggaaactgggagttaggctacctgtgtagtcttctgattttactaagaaacagaaaataatggaacagggaacacacagagaggaaggaaccaggaaaccagttttccccatcctgatagtcactcttctgtttcccacagctgcttccttcagcagtaacgtctcaccattgagtggccagggtgtcctcagagccatcttgggtcccttggtggcctgagtgggtaggtcatagtgggtgtctacctaagcccagtagggccaatatttattgaatgactgttatgtttcaggcacattgcctacagtccactaatccttagagatgagaaaacagaagatgacaagttaagtaattttccctaagtttggtaaataaggaaaccgggatttgaggctatctgatgctcaatcctgcattatttctgctaacccaagctgtctgtttcatcaggtaacaatttttttttcaggaactcgtttagattttatggttgtattaggaaatcaagcctagaataatgcatagagtcatgctatgctgagatgtttattagcttctattttcagagagagctagatttgctttttcctggatcaactttctaagttctaaagcaaatgccccaaagaatatttcaggtagagcttagttctccatcttgaaaattcataccacaacccttcttgagtgcctgctaagagcagtttccatgtgaagtgcttggagatgattaaaacacatcactgcctatggggctctcaaggtgaagtgaagggaactcctagagacccagagaactgtacataatgagaaagtgcagtggtgcagctgagcacgggagcctagaaagagcataataccttcaactgctattgattgagtgttactctgcttctctgtctctgcttctctgtctctgtctagcatgcctaagtttgctatttccaagatctggattttggggtataatgcctatctgctgtttttttttttctgtccccctctccccactcttttttggcactacactgtttttcttctgaaaaactgtccttctgccatacctggttcatgtgactctgaagtgtggcttgatccacttcttggcaaggactcacatgagaggcctggcccattggtgtattccacatccctgtccagtggctggtttgggaataggcatgtgacccaagtcagaccagagcagagtaatctgaggacattcagggacctatggagaaagagataccctctttatggctgctgagcaggtaggaggcacagctggatatacagagctcccatagaggacagggtgcctgggaaagaagctgatgtagaagacaaaatgtgggcggggtcctggcgacaactttgtgtcctgggccaggccatatttaactagatgcatggacttgtagatctgtaatcccacaaatctccaacacgtcctttaccctatctcaccaggaagagtttgagtaacccttaatataataatccaactttcatctgctattgttcttgggtgaatagctattcacttctctgggaagttcatgggggaggagtgactagtagggtaggatccaggccttctggtgtccatggttgtaacgtcaatcacaatactgtcaaatgtcatctgaaactcctaacagaggtcaccaacttcatctccccacttacattcagatataagatttctaaaaatcttttttttttttttgagacggagtcttgctctgtcacccaggctggagtgcagtggcacgatctcggctcactgcaagctccgcctcccaggttcacgccattctcctgcctcagcctcccgagtagctgggactacaggcgcccaccaccacgcccggctaattttttctatttttagtagagatggggtttcaccatgttagcgaggatggtctcgatctcctgacctcgtgatccgcccgcctcggcctcccaaagtgctgggattacaggtgtgagccaccgcgcccggccttctaaaaaccttggtttcaccatcaatggttatttgcaggtcacgtcactggtcactggtggccttctcacagcataaaactgttaatgaactgagactgtagacttgaaaaaagtgtgaaatggaaaaacaccaaaacacctgtcttctgtgatgtttgtatacaaccaattatttgcaataatcacaaccggcttgaatacaatataaaaagaacctttccattatactgttaaaagtatacaaatgcctcactcaagtctttcaattaatataaagtatgattgagaaattaagcttgttaactttccacccccattcacctaacgcaacatattcaatatcatatataagaaacctaaaaccacacctaaacatgtaaaactcacctaaacattcatgttctggtgctattggctgtacaagtatgaggagatagcttttaaataaaaatggcaacatatattaagtatatttcatgaggtaagaaattgcatgattacctaagtccttttgatgtaaattgtaccacattttgcctgctctgccggtttaaacaaatccacagccctggaaattactctagatttgatttttgcgcttctatgcaaactataccacaacccatcttgcaaactataccacaatccttcttgagtacctgctctagatttgaactagagcaggttgcttgggtccctaggcctaggtgttcccttcacttcatcttaagcgtctcataggcagtgatgtgttttaataatctccaagcacttcacatagaaactgctcttagcaggtactcaagaagggttttggtatagtttgcacagaagtgcaaaaatcaaatctagagttaactactctagcaccaaatccagagtagttaacactcttgaatacctgctctaaatttaaacctgagcatgtttaaagaaggtgtcaatctgaagaggtaggaccagtcatcactgtaagtaatgaaaagggaagtcagtggaggaacatatatttcttcaaatacaagaacattcccttatgcaagctttcccttccccaaactctatgcaatattatttgtccagtggcaggaatcatgcttaagccattagcatcataaattgcttagaaaacaaagtatggcttatttgaaagatatatggagaactgagcaaattaagtctgtccctgctgttttatctttatttattaatggcaataattctgtcctaatcgtttgtatagcacttagtcaattatgtggcatctaaagctcttcaagtgattttagttaatgtcttcctttttctcctgcacaggcagatgcaaattgctctggggaaagttgtaaggtcaagggcagttgtggtttctgctgttaagggaatctgtacagtcacccctcttcccaagacaagaacttagaattgatgaagtaagcaatcaacagatcacagcagatataaggaaagtactttaaagagacggaatggtttgcaggtgtaggggatgataatggtagttttattggaagtatgagcatgtttaaagaatgcatcaatctgaagaggtggggccagtcatcactgtaagtaaagaaaagggaagtcactggaggaacttggctctgtccatctgagctctgtggccaggggagcagccacgtgggattccaattgattagtacagaacaggaccctggcttttgaggagaggattcacggggataagagccagtgaacctgctgataagatcacttctaccaagcacttcattcctgcaaccaccttcctttctcatttccagttccatagtcagcttgcaactttctgattagaaggtggctttttgggtggatcttttaactaaaggaagaaatgctttggaataggcattttgagttttagtgtttttgtgatatgttttaaaaatattttgtattgtggtaaaataacttgtaattattttaaccatttcttgagtattcaattctgtaacattaagtacattcacaatgttttgctatccttatcactattactagaactttttcattatcctaaacagaaatcctgtacacattaaacaataaaaccccatttccctctcctctcagcccttggtaaccactattctactctctgtttctgtgtctctgtttgttccagatatgtcatctaagttgaatcatacaatatttgtctctgtgactttggctgcactcatttaggacaatgttttcaaggttcacctgtgtcgtagcatgtatcagaatttcctttcttgttaagcctgaataatattccagtgtgtgcacataccacatttcattcatctattaatctgttcatagacattatgggttttttccaccttttggctattgtgaacaattctgctatgagctttggcgtgcatggatctagttgagttcccattttgaatttgtttgggtagatactcagaagtggaattgctgggtcctatggcaagtctctgtttaactttttgaggaatctccaaactgtcttccacattggctgcaccattgcataatcccagcggcaatgcacgaaggtgccagttgctccacatccttgccagcatttgttattttccatgtttttatattaaccattctaatggctgtgaagtggttatcattgtggttttgatttgcatttccttaatgattagtggtactaagcatcttttcatgtgctttttggccatttgtagatctcctttggagaaatgtctactcaagtcctttgcccatttttaaaattaggccttgtgatgtaatttctttatgtgaatttgtgtaacttcttcattaatcaatggaattcttagtcaacttggctgtaggaagggactgtgctgattttgttgatgcaaagagcttggcttactgctttgcagttacttctattataaattaaattgtccctgtagtttatttcagttttccaagccagattatcttgatttatgcctaataggtggattttctcttgctgtactggcaagtctgattctgaacttgtgaggcggtgggtctgaacccagatcatagcatgctctccactttaatgagataccttctgaggttcctggggcgggaactactggctctggatattttctaattaatctgcaagtttcatcgtccagtgcagtggccagtagccacacgtcatcacttaaaattaaattcaggttaattaaaaattaaataggctgtgcactgtggctcacatctgtggttccagcactttgagaggctgaggcagggggatcacctgaggccaggagtttgagaccagcctggccaacatggagaagccctgtctctactaaaaatattaaaaaaaaaaaaaagaaaaaaaaatagctgggtttgatggtgcacgtctgtagtcccagctactcaggaggctgaggcaagagaaaattgctggaacccaggagatggaggaaccaagatcaaaccactgcattccagcctgggtgacagattaagattccatctcaaaaaaaaaaaaaaaaaaaaaaaaggccgggcgcagcggctcacgcctgtaatcccagcactttgggaggccgaggcgggtagagcacgaggtcaggagatcgagatcatcctggctaacacagtgaaaccccatctctactaaaaatacaaaaaattagccaggcgtggtggtgggcgcctgtagtcccagttactcaggaggctgaggcatgataattgcttgaacctggaagacagaggttgcagtgagccgaggttgtgccactgcactccagcctgggtacagagtaagactccgtctcaaaaataaataaataaataaattaattaaattgaagaaataacccagttttttagtttcactagctacatctcgagcagtcagcagccacatgtgaccagcgtctgctatactgaacaacacagacatggaactctcccataatttcagaaagttctattggacatgttaattttttaaaataagcattttttggaatcataaacaatatttacatctaatagaaaacagatgttccccttcctgtgtccaagtgttctcattgttcaattcccacctatgagtgaggggcctgtcatggggtggggggagcggggagggatagcattaggagatatacctgatgtaaatgacgagttaatgggtgcagcacaccaacatggcacatgtatacatatgtaacaaacctgcacgttgtgcacatgtaccctagaacttaaagtataataaaaatatatatataaataaataaaaataagtaaataaataaataaaaaagaaaaaaacaggaaacagagaacaaataatagatggggaagacggaaaagaaatagcaagatgatagatttagatctaaccatatcgataatcacattaaatgatctaaacaccaaaattaatacacagatgttggcagagtgaatagagatgctacctataagaaacccactttggaggataattgacatctaaataacatttcatttttcagccaataaacgcagtgtatctctccgtttctttaggtttttaaattttatcttagcaatattttgtaattttgtcagatttgttcctaagtatttcacatttcggaagtcattttaaatagtattgtatttaaaattttaatctccaattctttattgctagtatatagaaatacaattggttatttatactgatcttgtatctgcaacattgccaagctcatttaatggttctgatagctgtattatagactccataggattttctacatagatgatttgcaaataaaattgtttactttttcctttcaaaaaattaaataaaataaaaaataagcattcttaaaggagctttggaaacaggtaaataaaactgaacaaaacagtaacaacctaaaaaatgactccgtgattaggcaatggattaaagaacaaaattaggacagaattgaaataaactctacagtctgactactagaaaagtgtccattagtattctctgctacagaatcattgtaaaatgctcatgttgtggggccgacgtgaggactcctgagcctagcacatagtgagcgctgtataaggaggtgacggtcctgaaaatgcactgcagagatctgctgctgcttagagtgtagctgactgctgtcctcatactgaggtcatgcctcctgcaggcagctcccagccaacagcagagtgtggcaggctgtcaacgcacacacattccagagaggcgcagattattttaacaggtgattttgacttgaggactccccattggcctcctcaaacctttttggaactgcgctgcagtccaagactcttcctaatacactctttcatccttcctgctcttcttcccagatgtcaaacttgtaacatcaattgaaggctctccccgtttccatctctcctgttctttccctcagaaaatctcttgtgtgtctaatcctatcttaacatcagcttcatggcagacccaaactaaagccaagtgttcactgttagtattactctccagaagacatttcttccccctttccccatgagaagcctctcagaagccttctcagatggaaactctcatgtcagctaagtgaccaccatttcctccatttcaactcacaccttggagagaagctcttgtgagcttctcagatctatcagcacaggcttgttaagatgtcattttggagtcctccagaggtctctctaattctaggctattggtgggggtttgttcttttatcttccattcagttccctgaagtacattcccaatccagatattactgttgcttctgccttctggtgtaggttacttttctttcaattgctctgtgtgcataagaacaccctccattttaatcatgtttcacagaaaaacctggaactactccccccacccccactgccccacggtttcagaaacttccctcagccttcgtgtcttcttccacagcttaatcaaacccttgggagtgctggaactgagttccggttttcagtctgctgcccagtcaatgctcgttcctttctttctgcagaatttcactaatattactccttcaggggctcccattttatttcctagggccatgtctattcagaatatcaccattgcttgcatgtaaaaaatccgagatacatgccagtattccccagactgtattctgcacaacctgagtgttctgaaagctacaagactgtcttgaaagctgtcttgtcagatgctggtgctctgctgacaccttggtcttaccattgtagtagtctggcttccaactgcaaatatctgtgtctctttgctttctcttgctctagaatgctctgtccatgagtgctgcaggtcggatattcctcagtcagtgactgagcagaagcagatgctctacctgggctcttaattactagctagaaccagggtggtgagtcgcttgataacagaccctttcctggctgccttcctttcctcagctcatgttctcacatactcattggcatttcctccaatcatttcccaaataaactccttgtactggaatgaatagcaggggaatccaaactaagatattgttctagtaaggaaagatgattcatggtcagacatgtctgggaactactaggttaaacaaaagcgagtaggtttcctagctgtaaaacttcaaagaacatttaatacgttgatttatttagtgactctccagggatgacaagtagacagaccatacaaagttatttggcaatgtgtgattgtggaatgcaatgcaagtgcaactgtgtgtgtgtgtgtgtgtgtgtgtgtgtgtctgtgtgtgcacgtgcacacggacacacacacccaggcatccaccacagaacacagcttaagaacagctatgatgtggttaactgaacccaatgttctgggaagagcaaggttttgctttttttggttttctcctcatagtactacttcccacaaaatgtataacgctcattaactcaaggacgtacaaatacgaaatgcataaacacatttttaagaagcagtagacgaggtaatgaacagtgcctactttggatcatggattactatggtgtttggggaacggactggaagacaagtaggctcaggactgacattctcatcttgtggacgataatagagctttgttctttggcacttaattaagcagttctgattgttctccaagcatgagaaaatgcatgtggagactcatgttaatggttctgctctcccaataaatctagttacatatagatccttagccaatttactttttcattatagagaggagaaatcataacatagcatgaactagaactaatttaacattgtacacagtttaaaacttcagtggagttgaaattaagatcattgaaaccccacgagaaaatttacttcctgttccaagatacttgggcttcccagggctaaatggacagtatttattcagcatcctaggtgagtctcactcttaggtctaacattgggtcacatctatggggatttcagcatggcttcacacaatctgtccctgccttcacctctgaggcaccaactccaagaaaaaactgtggatataccggtcaaattgggtcttcaaatatgatttactggggtaccagtatgtgtgtatgtatgtgtgtttgtcttgatatgggtctctcttcagggaaaaagacagagacacgcagagatacagagataaagagagagagagtgggagaaagagagagaaagaaataaagcactcacttccctcaaaaactcatacttgaaagctaaattaaaaattaaatatatttaaacttaacaaatggattcaaaagtcactaaacttcatttaaaaggattttagagctggccatggtggctcacatctgtaattacagcaatttgggaggccaaggcaggtggatcacctgaagtcagttaaagaccaccctggccaacatggtgaaacccggtctctactaaaaatacaaaaattagccgggtgtggtggtgcacacctgtagtcccagctacttgggaggctgagacaggagaattgcttgaacccaggaggtggaggttgcagtgagccaagatctcaccactgcactccagcctgggtgagggagcaagactctgtctcaaaataaagaaagaaataaaaataaataaaaaataaaaggtttttagatttcttttcaattttatttttcctaaagttttttgtaggtgacacatttatatcacattgaacaatagatgaaagcatttgcaaacatccatttaaaagtgctttctccataagcagtcattttatgaactgaatgttaatatctgccaccaccccccagttcctgcgttgaaattctaagtcctaatgtgacgctgttaggaggcggagcctttgggaggtaattattttatgaaggtggagccttcacgaatgggattagtgcccttaaaagaagagacagagagagatgttcgttctcttggctatgtgaggatgcaatgagcagatagtcatctgcaaactagaggcaggtctgtcccagcagggggcctgccagtgccttgatcctgggctttccaaaccccagaactatgagaaataaatgtctgctctttaagacttccaacctattgtattctgttatagcacctcagacagaataagacaaattattttaaaattgttgttaagcgtcacctttattttgaaagagaacattgtcttttcctttcaaaatatctaagaagtagtatatcactgtcagttatttctctggaacacttgccatttcattaaggaaacgtactcaaatgtttttttttaatcattttgtcaactcttttaagtattttgtcataaaatagacattgaaactctaccaaggaagactccatctggcaaaaacttttcctggtcattcctgactcattacaaagtattgcactggttttactacattttacaggttgtggcaaacagactccaaaatggcccctaggattcctacctcctgggaatcacaggcctgtgtaattcctcccctttgagtctgggtgggacctgtgacttgcttttgcccaatagaacctggcacaggggaggagatgtcactctatgattatcttacataagactgtaacttgcatcctgctaaggaactctctttactgactctttcccttgctggcattaatgaattatgctgccatatggaaaggaccgtgttgccaggaactgaaggtgtcctctagcctgacatcagcaggagaggaggctctcagtctaacagccagtgaagaactgaatcctgtcaacaaccacagaagcctggaaacagatccttccccagctgggcctcagatgaggccccagccctggcccttaccttgattgccatcttgaaagagaccctgacacataagccattcctgaactcctgacactcctaccactagcgaccctgctttattttcccctagcacctctcaccatctgacatttgatctatgtgctgattaactccatgagagagtaaggctttgctctgtctgctcttttctccccagtacctatactatacagcaatcaataactaatacacatgttttgcattagtttcataaatccaactaatcattgcagcaatagcttgctttcaaaggatgcagtgcttggatttcatttgtgcagctatatctgtaatgctcacctagattttgtttgtaaagttacagtcaagcagcctccccattaggggttccgctacactgtttttccatcaaacattgtttttactcaaaaaaattactcctatgaagatgttttatctaataaatcttccacttggtggcttataaaaaatgtagtttatcatatattgccttgctgaaacaggatctagcaaatatatcagctgaggcattagaaatatctgtactctcatccatgtaataatctaacattttccactgtataatttatcccatacttttatcttcaagattttactgaaatctcttcctgatttgttgacaatgaaaagcattttaatttgtcaacatatattggttcctatgtatccatttagccatttttcttcaagaggatgaataagtgcttccctaatgagggttttgctactgagtaagagacttcaacagatcttctaaacaagtatcattaagcttagtggaattttttaagtactgggctgagtatatagtacctttaaatttaagcaataaataaataaacaggtagttgtttttaggttctaattttaagtgtcctgctaattgtgatgatatcaaggctcaattacacacccagaatgactttcattattaaaggacaatccatattgcaaactcaatggctacatggtctccctgcttccaccctcactccttttgttaatctcagccagaaaaagcaggttatatcctgtcacatccctgggcagagtttccagtgcctcttcctcccgttcataggaatggcctgagtccttataggcccctgcatgacctcgaccttcatcagcccccagtgcttggatcatgtcacctcccacttttcttctcactcactgcttctcatccacactggccgcccccattgcctttacataacaccctgcccgatggagccttgctccccccacccctccttccctgcctttgcaattgcactttcttctgcttggaatgttctccctttggtatgcacaagactcttttcctttagggtctgctcaaatatttccttaccagagaagcctcccccagcttctcaggcatttctgacactggctcccctgccttattttcccctagcaccgctcaccacccgacattttatatatgtgctgattaactccatgagagagtagggctttgctctgtctgctgttttctccccagtacctagattatgcctggcatgtagaaggcatttgataaatatatattaaatgaaagactatatttcagataggtttcttaataataccgaattttttcattggttttcatctcagtttgaatcaggctgtcattgtttttatcttgtcatgtggttagacatattagttgttgttttaccctggttctcttgcgattgtatttttttggttattttcttcagtccacagggtttgttttttggaggattgccttttaaaacagctgctcattgtgtgagaattggctcagcttaaatgagataatgtagtttctaaattcacctaactgggtgtgcataagtcagtatgttttattatatggaaatcaaaccaatgacaggaagacttgatatggaccccttattgccaatggacagccagcctccctcgaaacacctccctcactgcgggtgacacatgaaggtctgatatttacttacagcacaaggtgcattagtcatgggaggttaggctatgctgtggtaataagtaacccccaaataccagtgtctaaacacaattcaagttcatttatcactctaagagagacagcatggaccagacagcttctctgcatgatctctttgcttctagggtcagtgcaatgtgaaaggaaggctgtgatcaggccaggaggccaatcccattggccagatcctggccacatgaattgatcatagctgcaaaggggtctgggaaatataaaggagcccatgggtatttggtgagcattacaatcctctgcctcaatctcaatccatatgcactaaatagtagtaaagtattgttcttttcattttttagtatgaaaataaaatatttcctttgtctacctcaatggataattttgtgtgtgcatgtcatactctggagatcacagctaagacgctgataacataaaacccatatttaaccaatatacaaaatatcatcttgttttgtgattttctcctttgtcttaaaatggaatagaaaaaaatttccagttaataatagtgccctttaagagattttctgaataatcaagctctattgccacattcacacaggacttgcttgtctctcatgtctcagtaagctggtcaatagcattaacaagcacacccttagtgagcagattatcaggaaaggaagaagacaaagtctatgcccatgtttatgtattgattatgctctgtttcaagatcaattctgcacatcatagatggctcgaaggtttgatttgggatggttctgcctaataaggacaaggaggaagtattaaaagcatctttcttttcagggaaatggaaaacaacaaaccaaaaactcttgctgagtggagggctctgatacattgcctgatccccaggcaaaagagagcattgtcagaggctgacgggtgacagtcaggcagtactgagaggaagaagcagaacatgcaaatgagaacaatatgctcttagcaagggtcagggaaggtgccacccatgtcacgggcctccaagatctttgagtcaagggtggaagatcccacttattcaatgccaagctcacccataggtacttccattttctcttagctttccagggtcacagcctttgttatcatctctgtacatggcctcttaaaatgtgtctatggcttaaaatgtgcctcggccttccgggtcctgagcactgacaccacgcctcctcatggggtccatatccccaggcttggacggattctctttctcagacattccaacacaaaagtcccctttagctccatttccctgtgataagctttggctgcttccaaggctcagcacaactccttttgagaaggcagggagtcgcctctgcacctgagtgttgaaggtgactttcccgagtgtcttcaaaagggcatttttctacttaagcttctggaagtgtgcttcctagagctgggttgcaatatctctgttctcaagatgtatgatgaggtcagtagaacgatctatgatcccatgagccaaacatgtttctgcctttactgcattagggacatgctggtactgtattagtctgttctcatgctgcaaataaagacatacctaaaactgggtaatttgtaaaggaaagaggtttaatgggctcgcagttccacatggctgggaaggactcacaatcatggtggaagatgaaggaagagcaaagggaattcttacatggtggcaggccagagagtgtgtgcaggggaactcccacttatataaccatcagatcttgtgagacttattcaccaccacaagaacaggatgggggaaaccacccacatgattcaattatctccacctagacctgcccttgccacatgaagattattacaattcaaggtgagatttgggtggggacacagccaaaacacgtcagataccaatagtgacaatcaccacaaaatcctcacttattccaataaaaggtgaggctcatcctatggcatttcaacgtgttgatctaacaactgcctaccctgagttatcagtgggctgcctactctagcctctcattacgttatgtgtcctgacttgtggtcttagtttatgtatcttacctactgactcctttaatttctgacaaccctaaatatttttatactggtctttcccagttgctgtgcctcagctgagataggatgctacctactaccctcctgaacagcatctttcctctttctactggctgtgtctgccttctctaacttgacttggtattagtgaaacatgactgacaaacccatagtaaaggaagggagaggaagaaatgactccttctgggttatctcacacacttatctgaaaaaaaaatcagggctcatggttcctgcacaaaagtttactaactctatgaccttgggaaagttatttcatgtatctgaaaatcaagattctccatctataattgtggataatatctatcctatccccatgtggttggtctaagagttagagtgaattcacaatgaaatacaaaggattctggaaatgtaagataatgtcactactctattattgaaaaggtcctggtgctgactttagttcctttattttaaaattgggttactacgtcatttacatactgcttgtgtttattatttaaaagtgtcccctcctttttctgtgtctactaaaatcacagtcatgaactgaccttctagttacattttgttgtcattgttctgttgttacagaggaaaggtgtatcattaacttgccttctagatatgaaccaagcatgcaactgtttgcctggcactgtattcaccatttctcagtattcttctactctgcctgtctgtggaattaaaggcccttccagggggcacactgggatggtggagctctgcagatttcagggttgtgggagaggttagagagctgctgggataagtattcatgaacaaaccaggtttttgcagaaacaaactcttcatactgaaaataaatgccactaggtacggaacctcacattttaatggcacaccaatattggtcttgtatatgcatatcaaataaaaatgactgagtaggtatttccatgtagtggaatactactgatactcaatactcagagaagtgcatttgcatagactttgggatgtctaatttacacaaagaagagggtaagtgtgagtttaatgtttataagataatgttgagcatttacttttagcacttctaatgagctaaacaaatctcttcattcaacaactccatttgaaagataaaaaacagcatttaccttgtacaaaagtcttggagctctgccctaaatggcaaaagtcaggcaagagaattggttgtaagttttctcctaaacatttaggctgggcatttggctctttgctgggcagaggaaggggctgaactcaggataaactcaggaagggaggagaaattaaagtaaacatcgaatttgctgtcattgctcacaagaactattttaaaaatcatgaaaaactactgactttggacatgcatcgtggctgtaaagatcaatgaatttggccataatgttcaatgagtatttgacatggtttggctctgtgtccccacccaaatctcaccttgaattgtaataatccctatgtgtcaagggcagggccaggtggagataattgaatcatgggggtggtttcctccatattgttctcatggtagtaaataagtctcacaagaactgatggttttataaatgggagtttccctgcacatgctctgttgcctgcctcatgcaacatgttcctttgttcttcctttgtcttccaccatgattttgaggcctcctcagccatgtggaactgtgagtccattaaacttatttcctttaaaaattacccatttgggggacatgtctttcttagcagcgtcggaatggactaatacagtatttatagaattaatggatgaggttagggcaagaagggcgagaatgcagtaggagtataagaagcattggtttccgagattcacttgggcccaagcttatgctcccttttcctgtctgctcagagaacactgaagagcatgctctgccacaagaggaggtctttgaggacttctttgaagtcccagagggggtcctgagatccaggaatcgagcatcaagcggctctcagatttgtttatatgttttggccaatgccatacattgtatggccttaatttagggtaaaaaaaatggctgctttagaaaaaatgttttgggcatagaaaaaaagaccttgattttttaaaagagattgtttattaattattaatcaaaggcattttttcaggacattaggtcaggttctataagaagtgtgatggcttattttttttctcttagtaaggctacattctacctgagaactcaggacctgaggacatggttataggaagaaaaatcatagatgaaaaatggttaacaatagtcagtacttagcattgattcccacaatatcattatgtatatttcaattcgattacagacaaagccattaaaaatgaattcttttagttctttaatttattcttaaattagctataccattttttctttgaaatattttatgttctttttcttttaaaaaacttaagacattttatttttaattattgtggatacacaataattgtatacatttatggggtgcatgtgatattttgatacaagcatataatgtgtagtggtcaaattggggtaagtggatgatccaccacctgaggcatttatcattttttgcattagggatattccaattccactctttgttattttgaaatatataagaaattattaactacagtcaccctattgtgctaccaaacactatgttttattccttctatctaactgtatttttatacccattaaccatctcctgttttctctctctctctactactcttccaacatgattcaaaaatcaagagggacaaaaggtacacagtaaagtgtcccttctacctgtgtctcccatctactcaactcctatccttggcagcaaacatgttgtcagtttcttatttatcctcccagaggtatcttatatctattttaaaacacaatgagaatataagagaagacagctcttagtcatagccatcccggacttcttcccaacaggtacagattgcggagtcttatttgtcttatccagggatcttggggaaagggtggctaatatttgaaccctcttaggggcagattctaagaaagtacatcttccccttcttctgggatttcaggtcagaaaaacagacacagaagcagagataatggtgactctgtagttgtgggatccatagctggcactgaaaaaatatatagtatatcattataaagcttttaatttttataaattcaaatgtatgttaaatatatacatagtatcagtgtccataatatcactatctgtccctcccagaggatctccaatgttatttatggtcctaatgtcggaggacaaattatagaacagtaatgactgaaacagagccagcctgtcctcaactctccccatgccattatgtatatttcaatcctattacagacagagcaagcaagtccagaacgaaaagtaagaattgtgccaatcaatcagaattagttttacctaaatgatattatgagatgcaaaaatatggctttagacactgaaattagacactgaagctggtgtcctctgtgcagagaatgctaatgctgagattgtggtccctagtggcaacaccagctgccccactgccgacccgtgccctgacgctcttcttggaaatcagcttgtcaaatgttgggagtgctgcgatgcgtctgcacggatccatttagaactccttctcattcgcattcatcacagctggcatgaattcacaagtgatggcagcaaaatgtttctgccagtttctaatgcctcttagaaatatgggcgtttttaacaagtggttgcctgactgctaagcaaacacactgagataatttctctgaaaagagagctcattgttaaacacggacacttctggcagtattcctgctaatccatccctgttcactgtgtcactgtgccagcatcatgtggacataagaatggatgccatagctgtccattatttctgacatcatggcaatatgttgggtggaaaatagtagttatttcttcaacacgtgaagaataatcatcaatagtattattccagcaagagatttaggtgaggtggaaaaggattggcccacacttctctgcccttctctccatggcataaataatggtgtgttccagggaaattgtttgaatgccgcagggtacttctggaaacctaaacttctgaaataatgctgcataacttcagaggtgggtaagaaaaggccatgctgagattgacttgctaaagaagttacacgtgggtgttctggctaacagcccagctgacctggctgcagccacatgtaagagctaccttgagcatccagcttagttgaactttcaggccccactggcaactgactgtttccatacaaaagactccaaaccagaactgcctagctgagtctttcctgagttcctgaactacaaaatcacaggaaaaataaaatggccaccattttaatcctctgcattttggagtaacttttaaacttggcaatgatgattgaactgatgctttaaaaattaaaatgtaagtattgtagaaataaaaacattagaagaaaatctaggagactaaaaatacaatctaggaattcaggagattttaagtgagttaaaatatccagactggatttatgtagatatatacacgtatatgtatttattatatgtatatacacacatgtatgaaaacatatatgtggccaggtgcggcggctcacgcctgtaatcccagcactttgggagcccaaggtgggaagatcacgaggtcaggagttcaaaacagcctggcaaacatggtgaaaccctgtctctactaaaaatacaaaaattagctaggcgtggtggcatgggcctgtaatcccacccacttgggaggctgaagcaggagaattacttgaaccgggaacctgggaggtggagctcgcagtgagccgagatcagtgagccgagatcacgccgctggactccagcctgggctacagagtgagactccgtctcaaaaaacaaaacaaaacacaacaaaaaaccatacatacatatttaacatatatttgatatcataaaaaattaaaaactttataatgatatctattataatcagattaaaggagctatggatttggaaaaatatatactcaaaaaagccttagattaataagaaaataatgaaatagaaaattgggcaaataatatgaataagaagtttacagaaaatccaactcaaagaagcatcaaatataagggtaaaaatactcaaattcactagcagttaaaataataagacacaactttagattgcccaacaatagaaatgaagagcccctatatggttgagaatgtgaagtgggtacacttgacatagccaatggaaatatgagttggtccattctctttggatcaagatctggtgagatctattaaaattaaaaaccatatgctctttaatcaccaagcccagtattaggaaactatcccagagacaaaagctcactacgtagggacagaagtacacagatagttaatgtaactttgtctcaagacatgaagatcaagtgaatgcccattaagcaagaaatggcagaataagctatgggtataagcacaatgtgaaatcgtatgcagttataaactattaaaaaaccagtaagggcaatggcagttgactttcaggaaaccaactccaagtgtcattgctgaatgagaaaagcaaggttcgtgggtgtgtgtacaatgtgattgcattcaaagcaaaacaaagaccatgaaacaactgtgtacgtgtttgtatatgattaaatgaacatggagaaaaacacatagggagatatgacggggtgggagaggcaagcaaaaaatgtaaagtgtacactgaaaatactaagcacatacagtatgactaccttcatatagaattacgtatgtgtatgcagatgcataagtgaggagataaaatatagatctatattcacttaccaattaagagtttttgatatattcattgaaaaccagtttgagaaagacaaacaaaaatcctgaaaatgtgtataaatacttgtaaatgatttataggaaaaggaaaaactgtggctgaagaatgagctattaacattaggcccccaggatggtgaagctggagagcagtctggggaagaagattcgcttaaaaaaaaatctttgcattgctctagttactccaacaattatgcattacttctgctatttgaaaaagtaaatccaatgccaagactttgagtattgccaactttccgtagctattggtgacattgcctgttttatagcctgcctctggtgacagtaaattgaattttgatcaggtaaaaaccaaatttaagcctgctctgtgcacctgtcaattacttgcttgaaatgctttaaatcactttgcttgaaatgccccctgacttctggggtccagttatacttgtggccattggtaaagggtgactttccatccgcttttccctggctgagattgaccatggcgtcagtcctcgtgtggtctccctgagattgggagggtccttccatgtccctcagtcttagcctgggctctttgttctggctgaagttggcattcgggtcaggcacctttcaggctgacatacatattatattaatccatccatcctgcatgtggatggggagaatgcatagcaccctcattgaaaatttgctttatctccctttgctgattatgttcttatcctttttgatcttttcttcaccctcctcctttcttttgcacagcaggcaatgggatggtgactctttatatcctaatgccaaagaccctaaggtcaaccagctgctgtctactagcctccttcaagagtcctattgctaatggttagttttttataccaacttggccaggctatagtatccagttactcactcaaacactagtttaggtgttatgatgacattttatagatatgtatataatctatatactatatatctctatatatagtatatatatatacactatactatatatctatatatactatatacatctatagattatatgtgatgtggtttatatatatgtatatatgatatacatatgtatgcatatatgatatacatatatatgcatgtatgatatacatatatatgcatgtatgatatacatatatatgcatgtatgatatacatatatatgcatgtatgatatacatatatatgcatgtatgatatacatatatgagagatgccaatatcagttgactttacataagaagaccacccttgataatgtgggtgggcctgatctaatcagtggaaaggccttaagagcaaaaccgaggcttccctgaggaagaaatgtctgcctgtggaccacagagtgacttcctgctggagagtttctgacctgcccacctgccctgcagatttcagacttgcccagcctgacttcacaatcgtgtaagccacttccttgaaataagtttccatacatgtcctactgggtctctttcactgctaacatactgacaaatacatttccccttcaactcgattgacctggaaataggacctctaagtcatctctttaggaaaaaaaaataggaggaattgggtgaggtgggtaagaggcctctctagttccttctttcatcggtgagtctgctctgtaaattggttggtaagattaataatttgtgactttgaaaatattatcactcaaaaaaagacattatttaagactttaatgaaacagaaagctcccctaaccctggaagagcaaacaggaacacaggaagcgttcacagctggctctcatggaggcctgctttccaggtacctcccagacttaggtctgcatctccatctccttctcaccaagctgtgacatcttcatcagtttataaagaatcacttcacacctgtaatcacagcactttgggaggccaaggtgggtggatcatgagatcaagagatcaagaccatcctgaccaacatggtgaaaccctgtctctactaaaaaaacaaaaattagctggatgtgctggcgtgcacctgtaatcccagctactcgggaggctgaggcaggagaatcgcttgaacctgggaggtggaggttgtagtgagccaagatcacaccactgcactccagcctggtgacagagtgagactctgtctaaaaaaataaaataaaataaaaaatccatgcctctccatgcaggaacacagcctgcaggaccagtgcagagagccttggggaccccaagtcagagcccctttgagatctcattgacaatgagggctatagatgtgcctccttctccacagcatgacccgcagaaactgtcaggtcacacccctgacccttaagtgcacaatcatacctcatcccaccccgacccaagacagaaacacattttcagaggaaggaaggggatggtattttacttgcctctgtataggctctttcaccacacatacccacaccccccacccccacacacacacgtaaacacatgcattcacacacatgagtacacaggcacagatgcaaacaatgcacaaatgtgcaaactcacacacacacacacacacacacacacacacactgctattgcacatgacattgtgaggtgttggccttttcactgatgctctgctgctctcacgttcacagtgtgtcctcggatctgctggaaatcagagccagtccaatagctgcagaaaggtccaatcatttccttgtaattactgcttgtaagggtgagttaagcattcagacaatggtcatctcctgcaagtctctctctagttacagaaggcagatcttcctcctgttcagttccatcaacttaaattgtaaaagacttgctttccagagggaatgtcatgccccagtacttgttacctctagctcctgcagaggccagttcagctcattctttttctctttgatccctgaccttgtgagacggtctcccacactccaagggggaagagttactcctagcctcctggattcttctccatcacatttgccctcccccaggccatggagctggagctgcagctgcccagcctggagacccacggaggaggctgggatgcagggtgaactgtagccgagggccacctctgcctctctcctagcccacacagaacctcgctctccttccagacaaagcggccacagatggagaagtaggtggggagggctcatctttccccccacttctctctctgtatccatgcttggttcaaatgaaccagaggaatggtaataaaggcctgctctggatgccagcagtgggagtggaaagttgagaatagatgctagaaactctatgatgtaatctttttacattaaaaattttacgtagtaatgccaagaactttatatctttaatagtgtagaaaattgatgacacccatttccttgagaagagggtcaccctctggatacaaactaataccacacagagtttctggatttcattctcctcaaaatctctctgccccagtccacagtgggtgcgagtttcttgcctctctctcagctgccactcttctgctgaggcagagaagttttctcatcctctgggtctccactataaccccaacttgcatgccccaaagacacgcacacccttcccaaaaacccagcagttctctgtgagtctggtagaaagtccccattatttgtggacctactcagccttggtgagtggctggtcccaacaggatccacaagaaacttgcatgaccgcaaggcctgggcacaagacaaacccttccactgccatgctgccattatggctgttgtttttccatatggtctcacatggcctctcagcaggggacgacactgatgggatttttatgggtctgtaaataaagctctttctttcccactggagttgtaaactgagaagtagacacaagaatcagacagatggagatcaaaacgtcagctttgctgctgatcagaaggaggtggctggatgtggtttatgccttcaggttgatgggcttgcgcttatctgcttgtcccttctcccatctgatttcttgtggagcccatggaggtaaagttggtatttccaaatcagacattttgcccaaaattgctgcccctctctggttctgagtggaaagggaagaaaagaaatcaaatctcagttacttatagttttccagtagatcagcctcaccaatcatgggccatgagccaatataatctcccacagactgagacctccatcccccatggtgaggggctagtgagactggaatacgaagagagttgctcaagtggcattccctcctcatgtaattatgaggcacagggaagaagagggccctgcctttttgctccctgaatgcttaacctttagattgaagtgttaagtccctggttggccagggaggcaccatcttgctcttgcggctgctcacttggcaaaagctgcccctgccttcagccacccactccccaatatcagccactgtgtcttgagtgtcttccggggactactgccagggagtatgtattttgttctcagaagctgtcacttgggtcagaatagtaaaatattcaaattaagtttgagccacactgaagtcaaagttggaaatttattttttctttctttctttgcattcttttccaacaatattgcccaatgtagcttatctgagattctgcaatgtgattaaatgtcaacattaatatgatctgggaataaaatgccaacaacccaaagttgaatctaaacctcttcttttattaaattctcttttaataggttaggctaggttggctggctgtattctggaccctggggctctcaaatagcagcaaacaattcccagatctcatggcttaacactaggaaggtttgtttccatggacttcactggccagcctgggctctgccctgtgcctccctggtcttcactctggtgcccagctgagagcacagcagccatgtggaatgctgctggccgtgtgccagagggaaactgagcttagctaggcacacactggtgcctacagcttttcctggaagggaccatgtccctactggtcacatttcatgggccaaagaaagttacattgcaccacctgagttcaagagggcacacaagtccaatcctcccttgtgcctggaggctgagagctgaagtagcttgcaccactctaaggaccagcagagattctcagaaagaaattaaaagaggcaactaataaatatgcttggaagttaaagttcaaataattctgtgtcttcagtaaagtctaaaattaaatattcttgctcttgtgaagtcaaatccaaagtctataattcccagtcttatattaatgtccaatgaaattaaggccttcctccatttctttctctgtttattggatctctgttctctggatctgtttctctgttctctggatctcttcaacaatcagatgtgaactgggctacccttcaacatgatgtgcttaatgccttcaggacttcagaggatgcattaggttaggtcaatctctcatttcccacttgaaagagaagaaaatgatctttgcaccgccaagattctcacagcactgacattccatcaccagctaacttcattgtctagaggaactacctaatccaaacatgctctcgggacatcacactcggtaaaatcttggcccgtgttactgatgccaaatacgccatggaaactccatgggatctgagtgtaggttgatgtacagagaagaaatcatccttgtttttatctctgcaggatacctttggttgcagagcactgtgactggggcagttaactccattgcaagaactgtcccttcaccaaaccaataatggccctacttaacctgtacatattgtctccttccccagagaggtatttgttgagaaatatttgagacattgctatcttctttcaaagtatagaaatatacagaggtggcacactttcttttgcaccttgggtgtcatttcccctctagcccagtgtgtggagtcccctcaggctgctctgagagttggtcctctatagtgtcatggctgccactgaatcttacaggcatgtgtgcagtgctgtgacagagtgaactgtttctattgcctcttgttttgaaattgctaagacccgggaagcctggttccaggggacaatttccctctagtcctcatgttggttttcaatcaagaaccatccttagaacatttccaaaccaaagctgctgttattgcttcgagagtctttgctcccggagcaccactcctcacctttggctgcagcttggaatcccttgggggactttaagaatcctgagggccatactgtacccaaccaattgagtctttgggggtgtgtgatgactaattgtatgtgtcaacttggctaggccatggtgcccagatttttggccaaaagccagtctagatgttgctgtgaaataatgttttaggtgaaattaacatttcagtgaatgttgagtaaaacatattaccctccataatgtgggtggacctcatgcaatcagttgaagtctttatgagaaaaggctgagattcccccaaataagagggaattctgcctccatacaagcttcagcttgagccgcagcatcaactctgccctgaacctccagcctgtcagcctaccctgcagatttcaaacttgccagcctccagtcttgtgagccaattccttaaaataaataaatctctctgtctctatctccatcactatctctctatccctttatctctatctctgtctctgtttatctctatttctatttctatctgtctctatccccattcctatatctatctttatctctctctatccctatctccatctcgatctttgtctctgtctctacctctatctctatctacttctgtctctatctctatccctagctacctctatctctatttttatctctatctctcttgtcctatttccatctctatctctttctgttctatctctctctgtctctatctctatccctatctccctctatctctatcccttctctctctctatccctatccctgtctctctctatccctatctgtatctgtgtctgcatctctatccctgtatctattcctgtctatctctatctcgatctctattcctgtctctctatctctatccccatctctatctctgtctctatccctatctttctctatctcaatctctatcactatccctatctgtctctatccctgtctctacctacctctatctctatgtctatctcttctatctctatgtctataactagctctatccttatctctttctctatgtatctctacctctgtcttcatctctatccctatctccatctccatctctttctttatccctatctctctgtctctatctcctctatctcatctctgtccacttcctgttggttctgtttcttggagaaccctggtgaatacaggtggtgctgatcttccaggcactggtagtgtttagagctttcctggtgactacaatgtgcagcagggtggacagccccttcctgagggatctaaaaaggaccatccccctttttctctgcttcatcttttgttatttgtttgtttgacaattgtaggggttctctccatggatcgcgaccctctcctgcccctgctatttccagaaagtgcagtggcatttctgacagtagaacctcatcttaagatcattccccttctgtatcaaatgacttgctcttccatgccttgctccacaaactagcagcatcagtcttacctagagcatgacagacaagcctagatattgcacctactgagggatgatgtcctgaagtactgcatccacagctccactgttctctcagggtccatctgcagctcatcctccctttcacatctgcccaatctcatctcccttcctgcatgccctgcctcccctttgaaacatcagctttccttccactgaaatcactctccttccctccagtttaattagcctgactgcctaaaaaaaacaaacaggccagctgcagtagctcactctcataaggcgaggcaggaagatcacttgaggctaggagttcaagaccagcctgggcagcatagcaagaccctgtctctacaaaaactaaaaaattaaaaaattagcttggcatggtggtgcatgcctgttgtcccagctactcaggaggctgaggtgggaggatcacttgagcccaggagattgaggctgcaatgagtgacccatgatcctgtcactgcactccaggagcaacagggcaagaccctgtctcaaaaaaattataaaaataaacaactcttctacagctccttttcttctagtaaagtgaagtacactttcatagccttctagctcctccttgattcttctagcaaatatggcatctataaagtaatccagatgcaagacttgtcagtgcacttctaacctttgggttcacaaacactgaattaagttgtttttttgccactccactaaaaaaagacattaaaaaagtgctgccattccttcatttaattttcatggaagattcactgaaatgatctaatttctttgtctgtattttgactataaagctaatacatggctttattcttctttatttgttgatgattcaaatctactatacttctacaattaaaactggtctggaactctaaaatcgaaattcaggattacagtttatgcagctaaaaattgcaaagccaacttgagatcacacggtggtggtgattggggtaatggtggagtgatgtggtgatcatagcagtagtgggatggtggtagagatggtatgatggcagtatggtggtggcaggaagatgctcatggaggtgacagtaaccatgatggtggaaatggagcaggaggtaaaagttgtgatggaggtaggggtgggggctgtgatggtaatggtaatagtgatggtgatggtggtggtgatggttggtggtggtgatggtggtgatattggtgatggtgttgcctgtgatgctgtggtagtgatgatcatggtggtggtggtggtggtgctaatggtgatggtggtgatggaggtaatgggagtggcagcattggaggtgttgaggaggctggtggtgggaggggaatggttgtgacacagcctctggacaaggcacatagtaaggagggattcatccctcaaattcctctcaatgcctgcatacacctactggaatttgggacagtgaagcagggagtgtgggacagatgctgctctgttggcctggtcctaccgattcaaaacagaatatgaactcaccattgcctcctgaaccacacagagcccactgactattatttaggggccttgcctagaggccccactgaggtaatccagaaaggggcaagtatgttttcatcacaaatgccaagacagcaccaggctggctgctctcctggagtccaggatcaagctgcagtggctcccacggcagcaggcatgtgctgcaagccagattggaagcagttttgctaaggttcttccttattaaaacaagctctgttctgcactagctgctggctgtgagttcagagggcatgggtttatggtggtgccagtagtgcctatttgcagcggttccaagcagccatttgaccagactcccccagcaaccttttcaatctcaccaattcttgtttttcttggggttctcagctcatgtactaaaggcgtatggcaaatgccctctatacatacattccatacatgaaatgtgggagttttagggggaatttaagcaacacccctctgatgtcatttctgaggtatttgaatggagagagcagggcacgcagggatgaaaatacgagtttatccctgataagtgctggcttggaggacacaacttaggtgggcagtcagatgggctgggtgcttccttctcccccaactctcctctccccagctgtctagcccttggcacacttactccaggcttgtgtctccctaacagattcacttaccctggttgctggcatgcctggccattggaagaaagggaaatttcttcctttttttttttacattctttccctcaacaaactttattgagcacctagtaactgccaagccttgacaagacagaaaataattttgtttttctgatacttatgtttcagcggagacacaagtactctttgtttgattgccttttgctgaatgtgcccagttgaaactcactttttaacctgtgaggagagtgataaaaggacatactctttgggaggctgaggtgggtggatcacgaggtcaggagttcgagaccagcctggtcaacatagtgaaaccctgtctctactaaaaacacaaaaattactgggcttggtggcagtcgcctgtagtcccaactactcgggaggctgaggcaggagaatcccttgaacctgggaggtggaggttgcagtgagccgagatcgcgtcattgcactccagcctgggcaacaagagcaaaactccacctcaaaaaaataaataaataaaaataaaaaaagacaggctcctggagcttccttctcaggggaaggaggagcatccacttccccctagtcattcagagaggtcaaatgcagtcctctttgggaagtgactggatgtgcagagaaagtcagagggaggtctcgccgcctctcaggctgcttcgaaggatctcagtctgtggaccaatgggcttttctgcattcggctgccatggcttgtggcacattcagcaggattggtttctgacctcccatcaggctgggagcaccccaccgtgtatgtagctcaataccgagagatttgtaaaggtttttattgaatgactctaaggttctaagcctgggtaacttgggttataacagcattcataaatggaaatagagatattcgaaagacacttttttttttgagggagaaactgctgagcgcaggtttagacttcgtgagatgtttagaggacagcatattattttttgcatggctggatttaatggttgttttgcatccctttgcagggttgagatagcagaggactctcagaaaccctcacacccagcattaagaggcacacactagatcagtttgcagatacaaatctttgtggctctatactttctttaaaatcaattcccagtattttaaattcctcattattcctctatcatgtgttagacaaatatgatatccacagatctacaaatggctataactatgctgtcactgcagggatgtcttgctctctgaactgtcgtcaggaagcttataaataaatacgggacacatgaagctaatttgataccaacagcaataatataaactctgactaagggaaaattggaaagtgttgctgatctaacagcacaaagaggcattaggaacgtgcgtctgcatgtacctcactcccaggcttgggctctttcccataacatttggaggctgtgatttcacctaccaaatacctatttacatgcttagcctttggatcatataattcacatctctgagaaaatgatgtattgttacctaaatgtatcactgctaaatgagatcaactgaagagtatgttattattggcttcaaactatgagttggaaatgtccacacacttgcaccttgctttggtgctattatttgtttttgattttgttttgttttatgtttttgatgggagagtgcggggcgtgatgatcatggctcactgtagcctccacctcctgggctcaagccatcctcctgtctcagcactcttaggactgactacaagtgcacaccactgcacccagcaactgtttttttggtagttacagggtctagctatgttgcccagcctggtctcaaactcttagactcaagcaatcctcccacctgagcctcctgggtagctgggactacaggcactcaccaccacgctcgattaatttttatattatttgtagagatggggtttcaccatattgcctaggctggtctcaaattcctaggctcaagcggtctgaatgcttcagcctcccaaagtgctgggattacaggactgagacttcatgactgtccagcgctgttatttaaaatacaaactgagttctctacaaggtggaagttttaataagtgatgcaccttgtcagagtaaaagctttcagtgggggaaaatgtgctttaatttagttcatctaaatttctccacactctcagcacagcgattatcttgccttctatatcaccctgacacatactattaacctatcaaacagcagaaggctgagcaccaccaggctccaatctatacagatagttgggccaattcaggtcaaaattttattggttttggcctaaaagctgctggaaaaacttgtaaaatgaagagaagttacaatgtgattttaaagcggatttcaaagatgagaacaggataatatcagtttctggctgcaaagttttcttctgttaaaaacctataagttaaataggcacacaaatatatttctatgctctttaaactactgggtataaagtgatcacaattttaagttgcataaaaggactgcaaatattaaaacacttgactacaataaggttccttttgggccttaggtaagtaatgttttctggtgttgttccagaaagcataataaataaaataaaattatcctttgatcataccaaggggtttgtgacagtgtgtattagcctgttttcacactgctataaagaactacctgagactgggtaatttataaagaaaagaggtttaattgactcatagttctgcatggccagggaggcctcaggaaacttacaatcatggcagaaggtgaaggggaggcaaggcacgtcttacatggtgtcaggagagagagcaaggtgggggaactgtcacacacttttaaaccatcagatctcctgggaactcattcactatcatgagaacggcatgggggtaaccatccctatgacccagtcacctcccaccaggtccctccccgacacatggggattacaattcaacatgagatttgggtggggacacagagccaaaccatatcacagtgataccacaataagatatccataagtgtcagtttcttaaggcaattttccaaagtaccccacatcggatagttgaaatatctgagatgtattgtcccacagctcggaaggctggaagtcctagatgaaggtgttggcagggttggttcctttcgaggctgtgagtggggatctgctccagggtcccctccagcttctgggggttccttggcttgtagcaacatcactccaatctctgccttgtcatcacatggcctcttccctgtatgttcgtctgggcccaaatgtcccattttcataaggacaccagtcacactggattaagggcctatcctactccagtagaacctcatcttacctaagttacatcttcagtgaccctcttttcaaataaggttattttctgggcattgggactttaacaaatgaattttgggggaatctgatataaccgatcctaccccccacagtgatgcttgggcacctcagggagcacccccctctcagccctgcatcccagtccctcatcccacctcctgctcctggctttgttgtgccttgttccatctcacggcctcacccgcacaccgccattttggttgggctgtctgctttgtccctgaacgctaccttctaatcttcccttgactcctctcctgctcagagcccaggctgcctaaatcccagaccagggatcggactctgaggagcccccatttattcagtaagggagtgtctctgtccccttaataaactgttatcctgcttcttgactcatggaggaacagcaagtcctgaagaaagatgcaggaacaagggacccagaaacccagccaggtgggcttacggcatctgggaaactgtgttttggaacaagatttggggcctatttgtgagcacattgtcctaaaggcatttttgagcccaggataggtaaggaaatggaattctctgctgagatcactattaatatcttacaccacctagaaaaaaatggtgtctaaaatatccaacctgtcagacaaggagctttgattgaagatgcaatcacacagccaagccaatgccagctgacaaaaggagtttctggggtgggaaatgggtgggatgtgtccagggatttaaaacccaatccttgcaggtttaaacgaagtatgatttttgacaggaggttctcagtggagtcttgtatttttctacaatttttgattagggcctcatggactggaatctacctattctctgtctggagtcatagggtgctagtgggtaagtgtgatgttttcataggtagcagttctataaggtctcctgtacagtcatctgtggtattttcaaatgtttacctctgctctataaagaatttgggtcacttttgactatgtaagactttggtctgaattatttagactaccacccctactgcagtagtattttagaattccttctacaacttcagtggctatgacatttactaatcttggcatatgatttctgaggaagggttgcttaaaataaatacctaggcgcccagatacagaatttagctatggtgaaatctcaactgttcagtgtctcctgaaaatcagtgatatcttctggatgaccaaattgaccaaacacttgaaggctaaacttattcttccccagaacattaaaatctaagtttcacttgtatcgtattttgtttttgctggaagtgtgggctttcttttaaaatagctgacatcaatcaatcaaaccagtttcttaatagtttatcatggtccccgggcactccagttattttgtcatgtttccttgtggctccggttgtattaacagatgcaaacttgcatgtagaaggtgtgagggcacagagcatgttgcacatctgtatagagcttgctttcatgggaatctgttgatattaatttcagatcatttttcttctcatcaagatgaagtgaggcacacaaaggccacttggttgaggtcattccccagcctctctgcagacttagagaatcaagccctgagtccatcttccacggagtgtttttcttaccttcctaaaagagactcatcttctgattagcccagttacctttggtatcttggacccatctatggcttggatctactttcccatctctagttctttatgaaaggttcacgaggatttttttctcccttctacagtaatttgtgctaggagagggtacagactgactctagatcaggggttctcactgggggtgattttatcctcttccttggggatattgagcaatgtctggagacattttgattgtcatgatgagggggtgaggtgctaaccctaaccctaacccacctagggagtgagtggaggtccaggatgctgctcaacatcctacaatgcacaagacaggcccccacaacaaagcattatccagttcaaagtgtcaagagagttgcacttgagaaaccttattctaaagaaaataacactttggcaacataaactgagctacaatctctttcaacctctctttatctgtgataattcagagtattaacctctgttagcaattgcatcttaatattaaagttcctataaaatgcctccctgatggataaaccttttcatatagtttcttctctaacacacgcttcgtaaagcatgataatccataggttgaatctagtaaaggcaggaagtgaaggtaggatgccagttaaaataaatacatgcaatgttaactctgcaactggaaggagaactcagatactgtcttgcgctggttgagacaacttttttcaggtgtcaggctggtatctgcattagtttcccagggttgctgtaaacatggacacaacttgagcagcctaaaaacaatagaaaggctgggcgcagtggctcacgcctgtaatcccagcactttgggaggccggggtgggtggatcacaaggtcaagagatcgagaccatcctggccaacatggtgaaaccccgtctctactaaaaatacaaaaattagctgggcgtggtggtgcatgcctataatcccagctacttgggaggctgaggcaggagaatcgcttgaaccagggagtcagaggttgcagtgcaccgagatagtgccactgcactccagcctggtgacagagtgagactccatctcaaaaacaaaacaaaacaaaacaagcaaacaaataaaaccaatagaaatgtactctctcacacttctggaggccagaagtaaaaaattcaaggggtcatcagggccatactccctctgaatgctctagggagagtcctttcttgcctcttcagctgctggtgttgccagccatcctgggcattcatcagcttgttgttgcatcactccagcctctgcctgcgttactatttggacttcttccctgtgcatttccaaatctctctcttgtaagtcattggatttaggactcattctcatttagtctgacatcatcatactgtatctgcaaaggccatatttccaaataagttcacatttataggtactccatggagattagaacttggacatatctttctgggtgacaccattccacccacagcagtcagtagccaggatgtatgaggcactttacttccccacaccacagaagtccttttgtccctgtcaatcacgcaccgtctgtctctggcagtggcaatgttgttgctgagtcagattgctggtggcagggttgtcatttgcttgtcttcatcatgtatttcagcctcctgtgtcttttcctcctctttcttctttattttcccatcaattctccttgtctgcctgattttaccaccagaagctaatcatgatgcactttcctttatgataaagatgctcaccccattcactgagcatgggatccgactctttggatcttcttggtggtattcatttgctgcccattgcctgggagcacctggtaattgcagaagatattttcctctaagtgcttaaatgctggcagtccttaggggaatctgaggcttccataaaactggacttcagatgacaaagccatgctacattaatagctctagagatctgcagttgggatggcttatctttcagatgccatcattttggcttttaatttgtttgcgaacaatatcctttggggagctgcatccttcaacgtctgcctgcattatcacatgggcttcttccctgtgtgtctccagatctccctctcataattcatcggatttagggctcaccctaatttagtttgacctcattttgattatatctgcaaaagccatgtcttttacctgagggtaacagatagtaagaacttgtgggcatcacctaagagcagggagtgaaaaaaccaactgaggaaagaaaaatgcagggcccaaaaacctttttaaaatgtatttatttatttgagacagtcttactctgttgcccaggctggagtacaatggcatgatctcagctcactgcaacctctgcctcctgggttcaagtgattctcctgcctcagcctcccaagtagctgggattacaggtgcacaccaccacgcctggctaatttttgtattttcagtagagacagggttccatcatgttggccaggctggtcttgaactcctgacctcatgatccacccacctcagcctctcaaagtgttgggtttacaggcatgagccaccacacccagcccaggaaaccttttaattaaacaatgtagtcgaggtctgtgggaagaggcagaagggataggattgtccccaccctctgtcaatgttcaacagcctgaaacccccatcttgttgtaaccctgatgttgctgtgtcactgctcaagcagaaatacagaatgtcaataccagagcaaagatggactcttgagctgtgttctattggtggaaccaagggctttagttggagctacgaaagcggcataagtatacagaggagtctagacagtaagcctgggcaagccaggcaatgactggcagaaagacaattattattcctgccgtgtgtgcaagtgcgtgtttggaggggaaagatgaggtctgattgtcttcaggctttccaccagattagtgtttcccatgaaacctggaggttcatggacgtggtcttttgggggatggttccctgggtctttttttgcccttgtaaaatattgacaggtaagttttcaacaagaatgctgctgtcgtctatcttgtttaagattgccaccttcctctgcctctgaaatctccataccacttctgtgctttattttcctcctaaacataatcattttcaaatatactatatatctactcatgaatcttgttgattacttccttctccttaggacgtgagctccacaagggcagagggtcttgtctgttccattcactgctgtgtcttccgtaaatgagacacatggcccctgggccatcctggcttcctcatccttcaacccttcaacctgcacatacttgttattatgtggggtgtgattttactagagggaaccattcgatgttgcacatataagggatttgtaaaatgggaatagcaatagtattgagccgatgtggctgtcgtaaatgagtacctgtaaacaacagcaacaacaacaaaaaaaacccagaagcagcctgacctagaatgagtgcttggcagtgtcagcccactcaccaagaccctctgatggtgcttgctcaagccctggtgctctgctgccgaaaggaatccatatgtttgggtttccaccaagctgaaatcttaattagcataatatgtaaaatcgtgtcagtgttcagtttttgctcccttcccccgccccccgtttatatttccttaacttttggtacttggtcattgcttctctgttagggaaactactaataggagggaaaaaatgctaaaaatctttcagggaagggggaatgatcatgcttagttcaacaacttgcatttttaaagatttatgcatacatctggttttgttttctttaaaattatccttggctttataaatgcctatactcaatccaattgaatatatcaatgtttcctggtcttccataattgcatcatgaccccaaacacttagtccactcactaatttaattgtttatgtctggccatccaggcagacccatgcccttggtatgtgagcatgcttatgcataaggttagcactaacaggcgttagatgctttcagctttgctatatgttgtaaaactaatgatgatttgcagaaatgagtaggaatatacaattactttatggtcaaaaatttgaaaaaatacttgttttggctttcactgacactatgtaattggaaaaaaaaggtgatttaagaagaaaattgatttacacaaatgttttattaaggcctttgatttccatgcagaagggatattgatatattacttattttttaattgccaaatccttagtgaacattaaatgacacaaaaaaggattgtggcaaattggatctggaaacaagagttgttgctcttttaagaccaaaggttgactgagccataacttgccaaggtgattggagcaaagtagatgtttattcaattatttaactcaataaataattatgtgctagttttgttcctggcatattgtgtacacatggctgtttgccatccaagagggtatatagtacatttgggagttattatcatgtaggtcgagttggaaatgtaaagcgaatgaacatgtcttgggagataatgtagaatgaagagaagacaccactgtctttggatgggcagaccagctcacaaagaagatggaggaaatgatggaaaatgacaacaggagaaagtgtggtcttatagaccaagggaagagggagttcacaaaggaagaaacagtcagaagcatcacatgccacagtgagggtcaagtgagagtcagttgctatattgctatatttgttgctttggaataaggagggctgagtaagctataatgagttatttgggctgaagatgccaaacttgaggtcagtggttggaaaaaggaataaaactctgtgtctcatctgagtggccaaatgtgcctttgccatggcagcacctcctgctccctcacctctctgttatgcagccaaaatataattaagtgtatgattgagatatgctcttttttccttctgagcacaggatttctcaaccatggcacagttgacattcgagacccaatatttctttgtggtagggtatgccctgtgcattgtaggaggtttagctgcatccctagtctttgggggccaggaccaccaaactactgccccaaagttgtgacatccaaaaatttcttccagcagtgccaaatgtcccctgggggtcaaaactgccccaggcaagagtcattgttctagatatgtagccagggagctcaagctgcttattttgaaatgctcatcaggatagaggtgcggaacaagcagattttagatggaaactgtctcagccagaaacctggctaagaaaaggtgcgtatggtgatgaaaaccaaataaccaagtaactcagaccttaattatttaagcaaagtttatctcccctgaagcaatgaaggaattgtctctagaaggtcaacacaagactgtaaaagtcaataataaaagattgctcctagtcacatacacacaccttcataaactaaacatgaggaagcaagattggctaatggtgatggcggtttgttgtgggcatgtggttagcaggaccctccacctctctgaccataacgccctttggtcttcagtagttgatgacaataccagctcagagtcatataatttgttctctacctcatctctgccttccacagagcaaaaattcaggtggtcctagttttaaaggtagagtaatattttccccctttctcccttttgttctccacttggtttgtttttctgctttctagaatctggaggacattcctggcccttagcagacttattttccccttttcttttgcttaatctaataaggcaatagcatgtacaaaccatccagcgagaattttcctctcctacagagtgtgcggctgtgactcaggatttggtgtgtggttcacttagccagtcaacaaacaatggctgcaactctgttagcactgtgctctcacaggtgagacaggtccatgctctagacaaaacagttggctgccatttttcatttgaacaagttttgttcaacttgggggtagagataataaacaagtcaaatgtaaatttgaaagacaaaataaatacaaattataatcattggcagaaaaaaagtgaagtcctgtgatgggtttgagattatcctagattattttagtgggtccaatctaaacacacaatcccgtaaaggtagagaatcatctttcccagctgaatcagagagatgagacagaagaagagattcaaagcgtgagagtaacttgccccgcccttcatggctttgaagatgaaggaaagacgctgtgagccacagaatgtgggtgacccctggacactgggaaattatctcagctggcagccattgaggaagtgagatctcagtcctacagcttccagaagatgattctcccactaacctgaatgagcaaggaaacggactttgctttagagccttcagaagggagcacggcactgccaatgccttggctttaacccagtgagactcatgccagacttataacacatttctgttgtttaagctgcaagtttatgccaatttgttacagcagcaacaggaaactaatacactgggcttggtggctgagtggatatggaggagggggaggaccacagggtggactcctagatcagccagagggcaatgagtccacataccaaggtgagaaaactcagggagaaatggactatggagggtggaaaccagactgacgttttggtcatattaaatttgaaatgtctataagacatttaagtggagatactagcaggcaattgactatgtaagtctagggttcagaagaggagactgagctagtgatgactttctggactagaagaatacagatccaaggcaggaggatcacttgagcccaggaattcaataccagcctgggcaacatggtgagaccccatctctaccaaaataataataataataatgagaagaagaagaagaagaagaggaagaggaagaagaaggaagaagaagaaggaagaagaagaagccgtgtatagtggtgtgcacttgtagtcctcgtaattaaataccagcctgggcaacatggtgagaccccatctctaccaaaataataataataataatgagaagaagaagaagaagaggaagaggaagaagaagaaagaaaaagaaggaagaagaagaagaagccgtgtatagtggtgtgcacttgtagtccccgttccttaagaggttgaggtgggaggatcgcttgagttcaggagtttgaggctgcagtgagctgtgatcgcaccactgcactcctgggtgacagagtgagattgtccctaaaaaagaaagaaagaagacaggtgacaacatgcaacatggaactgagtggatgtaagaagtgagtgtggctggagaagcaagactaagtccaaatcaaagacaccacagtatgtgaggttgggtgggaaaggaggaggacatggcaaaggtgtcagataaggacccccagtagggcaaggagaaaaccatgagagcacagcatcagaagggccaggagccaggcatgggctgcaacggaggatgtgggcagctgagaggactagtggaagaatgacagacaggtgccacgaatttggcaatgttgaatggatgctggtccttggtaagtctgcattagtagggtggcaaggatggaagccagatgggaataggatgcggaggcaggggtgaggcgattaaattcagacaacttgttcactagaaacagaagtggagagtggatctagaatgggtgagagtgaagagatggcttttaaagatggatcaaagaacaaagctggggtgtcacattacctttcaaatttattacaaagcggtagtaaccaaaacagtatggtgctggtgcaaaaacagacacatggaccagtggagcagaatagagaacccagatataaatccacccattgcaaccaactcatcttcaacaaaggcaccaagaacttacaatggggaaaagacagtctcttccataagtggtgctgggaaaactagatatccatatacaaaagaatgaaaatagccccctatctctcatcatacacagaaatcaaatcaaaatagattatagacttgaattttagatctgaaactatgaaactactagaagaaaacactggggaaccaccccgtgacattggtctgagcaaatatttcttgtgtaagttctcaaaagcacaggcaaccagagcaaaaatagacaattggaattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcatttttaaaaatgggcaaaaaattgggacaaacatttttcaaaaagaagacatacaaatggcctacagttatattttttaaatgtttgacattgctaatcatcagataaatgcaaatcaaaaccataatgtagtatcatctcactcaagttgaaatggtttgtataaaaaagacaggcaacagcattaaggaaaaatagctaatgcatgctgggcttaatacctaggtgataggctgatagatgcagcataccaccatggcacacatttacctacgtaacaaacctgcataccctgcacatgtaccctggaactaaaaataaaaactgaaagaaaaaaaaatgaagataaaaaacaatatgcactattcaaaaaaaaaaaaaaggcaacgatggatgctggtgggaatgaagaaaggggaattctcatacgttgctggtgggaatgtaaattagtacagccactatgaagaagagtatggaggttccttaaaaaatagaaaatagaactttcttatgaccctgcaattccagtactggatatatatctataagacaggaaatcaatatattgaatagatatctacactctcatgtttatctcagcactattcacaatagccatagccaaaatatggaatcaacctaagtgtccacaacagatgaatggataaagaaaatgtggtatatatacacagtgtaacattattaggcccttaacaaaataaaacccctgtcatttgcagccacatggatggaactgggggccattatgttatgtgagataagccaggcacagaaagacaaatatcacatgttcttatctgtgggagctaaaaagtggatctcatgaagatagagaatagattggcggttaccagaggctgggcatgggaggagtacaaaggggtaaagtgggaaaaaatcattaaatgtctttaaactgtacacttaaaaatggtaaagatgggctgggcttggtggctcatgcctgtaatcccagcatattgggaggccaaggtcaggagttcgagaccagcctggccaatatgttgagaccccattctctactaaaaatacaaaaaattagctggacatggtggtcacgtgcctgtagtcccagctactcaggaggctgaggcaggggaatcacttgaacctgggaggcggaggttgcagtgagccaagatcgcaccactgcactcctgcctgggcgacagagtgatgagactctgtctcaaaaaaaaaaaaaaagaaaagaaaatgtaaagatggtaaattatatatgtatattttacctaaatttttaaaaaagatgagtcaagtttgtatactgatgtgaacgatctggtcggggaggataagtggacctggagagagagagagagagagagagaggaacagagagatagagagaaggggagagagagagaggagaaatgagaaagacagagagagatagaaagagagagagaaggaagagagagaagaggaatgagacagagagatagagagaagggagagagagaggaggaatgagagagagaaaggagagagagagaggaggaatgacagagacagagaagggagagcgagagagacagctaagggggaatgggggaatgaaaggacagaggagagacagaaataatatttggggagagaatatttggggagaatataggagatggaccccaaggcacacgcggaggaatcagcccatggcgttcactgtagtaggaagggaagctggggagatggatctgtagatttgtcagtgggaggcggatggaaaagaataaaaattcctggcagcacgccagctcggccttcccacattagtacggccgtaataacgacttgggagtaataatccaaaaattcggatgtggagagggagatgacactgcatcactttgatccaaatggcatttttatgatggctttaaatatgtttatgatgtttacaaggagaaagtctagaatgctgagcaaaaggatgcctttgggaaaggacattaacattttgctgacaacaataacccccatgcttgcctctctcctcccccaggccttgcactccttctagttcttttgttgttccacacctgcaaggttgaccagctgccccacatcaggggactcagctcttgaaggtgttatcccaggaatggtagtaggtctttctgagtcaaatcaatgtcctccaatttgacttccaagtgaacttgtaagcagagatactcattattcagctgatagtgttaacagagatggctcagattctagaattattcctgagacaggctaactggaccatctgcaatgattcatatcatgcgtggtcttcaggagtccacaaggagaaagaaaatatttaaacttttatgctagtaacttttatctcattcttttaaaactgtatgttgcagtatataaaagcattaatacaataatatatgcatacaatttatgtctgtatacaatcatacagtggtgtgatcaaaacctttatcctgaaggaagaatgtggtctcacaagcctacacacacacacacacacacacacacacacacactcacacacacgaccatgcatggcggttgtgagatagtaacgcaatggattttcattgacattcctattggtggttgtcctttcaagagtctctcctggtgggtttggatcgtaaagcacttgctgcagcttctgagctgtcacgtggtgctggcttctgaaggaaacgtttgcacctctgcataatgtttgagctaaaatgatgaccctacgatagtcatactatatattaattggcatatagaatgttatatatgcctgcagtgcacctttctgcagtgactaatgggcctagagaggtggcctctctgcaggagctgctcaaggcaggtgagcatggctatgttcctcaggaggacatcacctatttatagggccctgcattctttctggtcctcagcaaggccatttgtgaattgaggcaatcaatatcccacccacccgaaccccatgatttcttagtggaaatagccaatatccattctgagtttactcagtgccaggtgctactctgcattagtgctctaatgcagagaaacttatggtaaagataaggaaacagaagcccatgtggtcaggatttgctcatagctacggagtggcagaccgaaatttggtttcatctagtctgtctccaaagcccgcagtctgaaccatggtgatttttgcctcttgcactctcagctgcttgcagctgcaggcacaatgattccagatttacaaaggcccgcaagtttagacatccacatttacataatgacttaaggatttgcagatgtctgggaaaaattatcctgctcacttggattattgggactgtgtctcaactttccattttattttgcacgtgtgcacaatattttcaggtaatttctatgaaataatatcctgtcacatagttaaaggttataaacatggtgctttacctttgtttttgccttaatggccaaaggaaggaggttagcgagtgagcacatttgctccttttatctgcagtaggagcgttttgttggaagtatttccatgtagcagcatgaagccaaataagacatttacaaacagttttttttttaagttaagatatatgtttcatctcttgtttcacattgttgcactcaatatttgcaattgagttagcttaaagtaaagtgcatttattcgactagatggtttgctccagttgccccactgtgtttttttcttctatttgattgctgtcttggtactaagccagtacaaagacaggaatgaagatttacaaagttttcaaagattataatgggcccttgggtgtgatattttaaataggagctgactttaagtcaaaagctttcaaatcaaccagtaagtacttaacagaagtcctttcttcatgacaaggatgaaacacagagtggattacgcaaggtgaatctggtcagcccgggcctgaggtcacgtctgactcccagcaatggtgttttgcttggagacttctactgccctcttggcccctctgtttgacctggcatggtccatctgtagtcactctcataacatgtcatacattcctacacattctcattttctgtgctccttcaactttttttttttttttgagacagagtcttgctctgtcgcccaggctggaatgcagtggtatgatctcggctcactgcaatctccgcctcccgggttcaagcaattctcctgactcagcttcctgagtagctgggactacaggtgcatgccaccaagccgggctaattcttgtatttttagtagagatggggtttcaccattttggccagcctggtctcgaactcctgacctcgtgatccacccgccttggcctcccaaagtgctgggattacaggcgtgagccactgcacctggcctcaacttttattaaaaaacaaacaacaaaaaactgaggcagggccctgcctggtacccctgacagccttcggaagaagaaaacaggccttctctgtgggtcatgtctccagggtgtgcaggaccaaatactgctttattcataaaacaggtagctggaaagctgccccactgagactaaagggaatggggtaaatcatcctcccttcatttggctgtggcttctgacaatctagatagttgtttgcatacctgtgtgcacacctgttgtcattctgtttggacagatgactagcgtacaatacaggttcttcagaggatacgtaattaatcaaatcataacaacctcaataatataatctgaagaattaaaagcagggctctggtatttgttctacatagcattcatataaatgtccgattgctctttgcagcttacgcttggtagtcccaatcactctctagaaagggcttatgagcagctacctggaaggcctggattagggagtggtagcagatgtcatggttgagaggatctaggggaccaggcagataccccatcggacagtgggcatcctctaaactgtctctcactgacttcactatgaaccacagtaccataattttggtctttaccattttcaaaattttctgtttttcaaaccacaggttcaaactctatcgtagtttcagattagtagtccatgtttttcttatgactccacttatttaagaacttcagtgacatacatttatctccacgtagtgaggataaaaaagttgagaacaagaagctaatacgatcatcaagacacagtcacaggaagtaaaataggaaggaaggaaaaagaaaggtctaggtcttcagagacaagggagagatatggcaaggcagaagtccctaagagttcaatataaagacaggtaataccaccactcttaaggaaaatattcccagggattcaaagttgatcggttccatgtgtctaaaattcacttggacttgtaagagaaccccaactttaatggaagaagaaaacaggtaaaaatatcctcagctcagggttagtggcttttcttatctcaaataaagggaataactcattcatgttgctgggctttctttgtcctgttttaagaaatttcaagttgttggctacccaaaagctgcattctagacttcttcctcttgtcccactgggtagaagcatggcctgatattttccttcttcagtataataatttcattttaaggacagtcaggtcctctaaatgtgttattattttggttcaggctttaaaccgaataagccagccaaacattgataaaagcaatgtatctgagcttcccatatttactcggcacccagtgacatttggctcttatctactgagaatatgagagtgataacagtaggaaacttaagtcagagcctgcaggttcttatttaatatctatagacactaaaggatttgcatctggatttaaaaggaattactctgagaatatttaattccaatagttggaggaaattgctcctgtgatcagtacaatttgccacagttttaaacatgtgggtgacaatgactgactttcatatttctgtcctcggcagcgtgactgtacacaactgagtcgcagccactctcagaggggattgcagcctgcagctcacgtcttagagcttctgaatgcagcagagaaccaacttgctgagccactatcattattaacaaaacgttggggattttaaaagaatcctcagagagtcccagcaacatattcaatatggaatgataagggccaggcctttggagagttgaagaaaccattttcccagtaaacccttacatcaaatgtaccagtgacatctgattgcgctgtttcctctcttggaaatgctcttcccctcctcctcacctatagaaatttgattcacttgtcacaactgaactcgaatcctgcctcccccaccgagccaccctctctgaggtttccttccctgactccagttggaacgagtcctttcctacttaaggctattatgatatgaccctttgtccctaacacactgtacttccaaagcacacacgggtttacatgcccgtcctctactgcatgccagactgtcactcactgtccttagtgggggcgaggttctgcattagcaggaaccagaacagcaccttgcatgtccttaagcggccgggttttggggagctgaatctgttcatgcacacttggccttgtcctgttctcaaagctgctccacagacacggggctgtctcctctccgtggatgtccctggctggggcagcttcttttccatgcatcagcctgtagcacgatgtgcagtcttatgagcagtaagaataaatgtaatgtttcttacccagcaaccgcagaatgtgcacagctgcaagcagagtgtgtgcatgtgacagtgtatttgtgtaattgtatgtgtgtatgagagagagacactgtgcatatgtgtatcagatgtaactatctatgtcacgtaaccacatattagacttaaatgttactgtttcaagtttttaatattaaaaagtagattttgaggtcaggcgcggtgtctcacgcctgtaatcccagcactttgggaggccgaggcaggtggattgcctgaggtcaggagatcgagaacagctggccaacatgatgaaaccctgtctctactaaaaatacaaaaaaaattagtcggacatggtggtggatgtctgtagtcccagctactcgggaggctgaggcaagagaatcacttgaacccgggcagcggaggttggcagtaagctgaggtcgcacctctgcactccagcctgggtgacagggcgagactccatgtctataaaaagaaattgattttgattttccttttgtgcttgtcctctgatgtcaccttcctccccacaacacacactactgttgttaatttgttcagaccatgggttcctgactcacaattagaaagtggaagtgacagtagaaacacattgctttcactctgagcgcccatggtgggctgttccctattttcaggaggtagatgttcatgcgggaatactgctttgaggactacatgccttgagttcagaaaataagtttgatttaacgcgccccccgcccacccaccgccttttgttttgcagagaacgaagactcagtcatatcttaggatgtcttaggcctgaacctgaaaaaggcttccctgctttatgtcatcatcagtcaggatgctatctccctttatcttttgtcccgtgtgctgggaggacatggtccagggtgaaatgaaaaacaaagtgaaatgcataactttatttgcgtgtttctaatcatcctttaacagcaagaataatacactgtattataatagtcaaatttactctcttgagcttacttcatctggagaggtctactgactattttggtaactcttgtaagatttttcactagctcaagcagcatctctcaaagtgtcaactgttcacctttcactccagttcatgctgctttttctggctgtgctgctaggctgaatgcatcgctaacacccgcacaggggacacagcagattttagcagatgcctctgtggtttgcaatgggagggagcacttcccatgtgtcccaaatgaaaacaagcagaacttcaggtatgaatatatatgcaagtacatacaattagaagaatatgcagatgtacacatgcctcctgggcacctgttttcaggacagaaaaggaaagagtcagatcgtgtgtctctgcatgagctcaattgagaaaggggttccctcaccaaatattcaactcattgattgttgcaaattctgagctggatgctaatgaggaaatcaaacactggctccttcatcccagatttgtaaagcttattactgatagttttcagtctttccgtcttctaatttataacccaacttctaatgttcaagtcactctgctctgtgcaagaatctacccctccatggttgggagactttggcaaacccaatcagagatgaggacaaactgaatcagcaaaggaggtggtgctgaccaggttctgacccagcagcatgtcttgggaagaaactaagcccttcctcaatacctccccgccaagctggcactgctcattgactcagatcacaaatcctgggtaatctgggtggagcatgttgcccaacctcagtgacatttgctatttctatttttggaatagagcgaaaggatccaggagatcaattcggcttgatcctgttttttcctttctagtcaacctcctacagtgtgagcaatgaccctcactccacccccaggcatacacacccccctctacatcccacaacttaggcagtttctaagactttgggaaaatccctgggagttcctcataacacaaaatgccttgggctgtacaagcctaggagaagatgccaagctgtggtctaggctcagggaatagtttcgctgccccttcctccccacctccctacagacaccccccaccagccaagcagcctgttcccactgatgcctgactggggaaggagactgagtttgttagggccaaggccataagcacttatcactcagcaaccacaaaagcaactgggttttgtgttgatccctctaagattaggccttgaacctcctttgtgcaccccttcccaacagacaattgtacttctgtctgaaagttttaattaaatgactcctgcacaagctgtctgatttcaggagacatagcagcatctattggatcaacagttccattgtttgaaacatgaggactataaataggaggcagaaactgacagcacatttagtgtgtttgcctatgtggtaatggacatgaatagtatgggcactgagctggtgaacaacagaatctcaaaaagggaagaacacatttgcccaaaacattaatcagtatcaggctggcaggagagaatcaaagtagcttctgtggagagaagacacctcacccagagataaatagcttgcaagtattagaacattcacagtgaaaattaacccatttcctttaaaaaaaaaaaaaacttttaattttgagatacttttagacttacagtaaagttgcaaaaatagtacagagttccgtatccccctaatccagcttatcctaatgttagcatctaacaaaaccatacaaccaagatgacgactaagaaattaacattgatacaatgctactaactaaactgcagactttattcagttttctccagtgtttctgccacggtcctttttctgatccagagccaatccaggatatcaccctgtatttaattgtcacatctacttggtttggtccacatttttattactggttgtattttctgcacttttttgttctttgagacagagttttgccccttttgcccaggctggagtgcaacggtgcgatctcagctcactgcaagctctgcctcccaggttcaagcgattctcctgcctcagcctcccaagtagctgggattacaggtgtgcaccaccacgcccaggtaattctgtatttttagtagatatggggttttgccatgtgggccaggctggtcttgaactcctgacctcaggtgatccgcccttctcggcctcccaaactcctgggattacaggcgtgagccatcctgcctggccattttctgcattctttctacacttattaattgctgtttctctagaaggaagtgttattccttctcccccatttatttattggttttttccaaggagacatgacaattaaaaacagggtgatatcctggattggatctgtgacagctccttggtgttccctttactttcatgaccttcttacttttaaagagcattggtcggttatttcatagaacgtccttcagttttggtgtgtcttatgttttctcacgatgagattgagcttgtacattttggggttgaataacagaggtgatgggcccttctcagggcatcaggtcagagagtacgtgatgactatctgttttactattggtggtgttaacctcaatttttaggctaaggtggatggagttaacctcgattactaggctagggtggtgtgtgcctgtcaaaattatccactggaaagttcctatttttctttttgtgattaatagacatttatgttgaagggggtcctttgaggctataaaaataacttctttttttttaaattttgctcactaattttggtatccatgtgtagatcttgactggagaaatttttgttactggttgtattttccacattctttctacatttattaattgcaatttctctagaaggaagtgttattccttctcccccatctatttatttattcagttacttatttatatcagtatgaactcagcattatttattttattctttggataagaatgcaataatgcaatactataacaatttattttcctgatcaaattgtttcagctttggccgctgggagctcttacaggctggctcgtgccccctattgcaagcttctatttcttttgtttgactgcttctttactctctggtaccacaaatcctctatgctcgtcttatatattctttgctccagctttggaattaaccaatacttcaaaagtcctgtttccttttattgcaaagtcaaatttagaaccaagatctgggcaatagatgtgctcattgctactagaatgtcatttccactaggtcatctcagcagacagaactaggaaatgcatgtcatatgtaccaacccatatgtatatatgtatctatgtttatttctgcatatatttatctgtttatatattttaagtaaacacaagtttgtattgatactttggactccaattcagcaccacatggttcactctagccttcttccttatttgtaatgcctttccctgactgtgagagcctgactcacagcatctaccatacatttcttgttttgctaactcataacccagagacaaacaaatttaccaaataaaatacagcatggagtatagttcttgttgtctttagccttccagtatcgagtcaaaacagggtttccaaagatacctaggtcagctcttttgtcccccacctgtctcagtgagccttggtgattgattaatttctgacacagttgggtttctttcttactgtctgtgtttcttctcaactgcccccccttccattcagccaacatgctggttgattttaaaaatttaacttacatataacaaaattgtaattctgtacatcaaatttgtatgtcactctttgtgacatatagttttatgcattttgacaaagtgatagtcatctatttactgctatagtttcttagagcacaattccattcccactcccctaatttcctcatgatccctgcttgtagtttgtcctccccaccatcactcaactcatggcaaccactgatctgttttccatcttataaagatggaagctgtaagcttcacctcttccagaatgttgtataaatagaatcaaacaatatgcagcctttgggatgaacttctttcacatactgaaaagaatttaagattaatccatgttgttgtttaaattaacaatttgtttctatttattcctcagtagtattccatgatacaggtgtaccatagtttatccatccttgtttgaaggtcacatgggttgtgtccagcttttggccactatgaataaagattctatatagatccacatacaggtctttatgtgaacatatattttccttttcttgggtaaataactaggattgggattgctgagtcatatggtaggtgcaagttgaacactataagaaaatgctcaactgtttatcaatgtggttggccatttttgctttgagcgaatagcaacatatgagagttccatttgctctgcctccttgctggcatatagtattatcaagatttatggggcttagccattctaataggcaggcagtggtattaccttgtggtgttatttacatttcccaaatgactgatgatgttaatcatttttcatatgcttatgcaccatctttatttacatgcctgtttagattacttgcctatttaaaaaatattgggttgttcattttcttatttttgagttttgagagttctttattgtattctggacacatgtcctttgttagaaatgtgatttgcaaatatcttctcccagtttgtggattgtctttctaattttttaagcgtgtccttttcagagaaaacatttttaacttttataaagtccaactctttctttcttccttttctttccttttttttctttttcttttccttgagatagagtctcactctgtcacccaggctggagtgcaatggtatgatcttggctcactacaatctctacctcctgggttcaagcaattctcctaccttagtctcctgagtagctgggattacaggcacccaccaccatgcccagctaatttttgtacttttagtagacacggggtttcaccatgttggccagtccggtcttgaactcctgaccttaagtggtctgcctgcctcagcctcccaaagtgctgggattacaggcatgagccactgtgcctggccattattttttcttttataaattgtgctttggtattatatttaaatactttttgtctaaccaaaggtcattacaatttgcttccatgttctcttctataagttttatagttctacaatttaaataagtctattatcaactttgagttactttttttgtataaaatatgaagcatagtttaatattctttttaaaaatataaatgaaatattcacatgaatatgaaattttttcataattccagcaccatttgttgaaaatactattctctctacattgaattaattttgtacctttgtccaaaattaattggctattcttacgtggatctatttctgggttctcatttctgtttcattgatatgtatgtctggccttttaaaaatattatattatcttaattattgtagagtcatcataagtcttgaaatttggtgctatgagtcttccaacatttttcttctttttcaaaattgttttggttattctagatactgtgcttttccatatatatttagaatgagtttttcagtagctaccaaaaaagctttcttggattttgattgggattgcattgaacctatagatcaaattaaggagaactgacatcttaacaatattaagtattctaattttgaccatggcatatctttccatttagttagatcttgtttgatttatcagaatttttatagttgtcagcatgcagattctacacactaaacaaaaaaaaagatttatacctaagtatttcactttaggagccactgtaaatttattttaaaaaaattggtttccagtggttcgtttctagtgtatataaattaatatttgtatgttgaccttgtgtcctgtgacttggatcaacttgcttaccaaatctagaagctttcttttattccctagtttcttttttagatttttgtatgtagagaataatatctgtagagaataatatctataactagagacagttttatttcttcttttctagtctgtatgcttttttttttttttctgccatattgcacagactaggaacccagaacaatgctggataccaggagtgagagaacctccttgacttgttgaagatcttaggggaaaagatggaaagtctttcactaataggtataattataattaattatttcaatatcctttattggttaaaggcaggttcctaggtgatcacaagttttttttttcacgaatagatcttgacttttgtcaaatgctttttctgttatctattgaatatatacatttttttttcctttttagtctgttaatatgttaattacactggctgctttttgaatgttaaatcagtctggtagtttttggaataaactccacttggacatgatgtattatatttttaatatatcgtttgctgaaaaaaaatattggtagaatgcatttattgttggcagtaaagacctccatgttctttaaaagccaaagaccagggccagagtactgctggaagctaatctcctccctgggagccacacagataaggttaactggaagcaaagggctctggaagagaggaagccagggtgccgctgctgcgccccgttcctgcctggcttggacgtatctggaactgacctcattctttcactatggtggacagaattctaaagctgtctttctaagatgtcgtcccctggttatataatcaagcgctaatccaggtaatgctgtgaagggactttgcaacccaaattaaggaggctaatcacctgacctgaaaatatggcaattatcttgggttactgagtaggtccaatgtaatcacattagctcttaaaagcagaagaggaagccagagagatgcagcagaagggctggtgggactggaaacatgagaactttgtctgccattgctagttttgaagatgaagatggaggaagggaccaccgaggaatgtgggtgggctttagaagccgagaacgatgcccgcaaggaagcaagcaagggaatgcacccggaacgactttggaagcagatttattccccaaacctccaggaaggaacacagccccactaataccttgattttggcctatgagacccagagcagagaacaagctgaaccccactatgtgtggacttctaacctacaaaactgtgagataatagatagacactgttttaagatgctaaatttgtggcaatttgttaaggcagcaataaaaaacgaatgctttggcttagcaaacatatacggaagaccttctatgtgtcagggactgccaggtgctgaagataaggagactgggaagaaaaacgacctctttatctaaggggcgcaccaaccagagggagactataacaccaaacaaaacatggaggtattccgtatatgtgccgtaaaagcaaagcttatcttggttgcaaagaataaaaagcaattctggctaactttaaataacaaaagaaaaaaaaagagagactatgtgcttttaattttgagagcaaagatactggaagattctagtttgaatcttctagtttgaaggaaacttcaaacatgtcagatttggggaaaggacgaccagtacattcccaggaaccttagtcatagaagtttgtagactttctgctggttctttaactctgaacccacagttcttggccttaatttatcctttccaaatttaaaattataagagggaaaaagacaaggcttagattggtcctcttcaaggacggcatcaatctattcatgaaggatccaaccctccccagcccaaacacctcccattaggccccaccttaaagactagtaatcaaatttcgacatgaggtttagaggggataaatatccaaactatagcaagggtaacctgttttacttagagtccattaaaaaaacatcttcacagcaacatgcagcctggtgtttgatcaaatttctgggtaatgtggactaggcaagttgacccataaaattgaacatcacatcttgtggtacacataacccatggggtctagctctatgggtcagagcctcatccccagaaagaagcctctttatgggccttaaagttagtcaaacaggtgctcccaagactgtccagttgtcagccacacttcaattacccctacaatgaggatggtaatactcataggattttttttgtgtagcttggaaaaagattatgaggataaaatgattttgttaactgttaagtgatgtgcgtatgtgaagttggcattatgtattttaaattaagattcaaggaaagttggcaaactttgaaatctagaatttgtacttgctactaaaaacgagtaatttttaagtgagacgtcaggaaaccccaaagccttttcgtgattccaaatgctgtcagaaactcctcaaagcaaaactccaccatctgcactttaaattgaaaagtgtggcgagtcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatataccccatggaatactatgcagccataaaaaatgatgagttcatgtcctttgtagtgacatggatgaaattggaaatcatccttctcagtaaactatcgcaagaacaaaaaaccaaacaccacatattctcactcataggtgggaattgaacaatgagaacacatggacacaggaaggggaacatcacactctgggggctgttgtggggtcaggggagaggggagggatagcattaggagatacaccaaatgttaaatgatgagttaatgggtgcagcacaccagcatggcacatgtatacatatgtaactaacctgcacattgtgcacatgtaccctaaaacttaaagcataataaaataaaataaaataaaaagtcatgaagatattaaaaattttttttaataaaagcacgatccatataaggaaaaaaaaaaaaaaaagaaaagtgaaactgcgatcatccctgtctatcaggaacagccaggggctgatgaattgcaacaggatagggttgtcccaaccccaaatgacaaagactcactgccctgaaggataaaagtgggaaaaaacctaaacaaaaatcacgagttgagccagagatgtttgtgacccaacagaacatggatttttcacgttctcttgtgcttttctggtctttactggatgaaacatcagagcatctatgctgattgtattctgacaaaactatcagaggccagagtgagtcttacaaattttgtgtatcttattgcttcacagtcagtcccttctttatagcatggctgagtgctgaacttagccccaactttttaaaaattaaaattggtcaatattgcaaccctttcctagcccttctgtcttctgtccctccctcccttctatccttcttgcagatgtaattcaggcagaattctgacattcatgtatcaaacttgctgttgccggcatcattttgcttagtgttcattatcatttctgaacggttctatcaggcaaaggcgtcctcgttctccaagcaaggaagccccagccagacagttgtcaaggcaacggaaaatgcacactgtgaactaccaagaaaaggccgtttctggctgctaagagtttttgcactcttgaggctcaaacttaatttctgggcttggcaaaaagaagtattttatggctaattataaaatgtacccaatgttattagactaggggatagatgattgcctgctaaatgtgttgtgaaaaattaaagcagttttcagagcggagggagctaaactcagtgtgcccaaaggatcgatcgcttatttttgtcattctttatagctggaatacaacagttgatttgagtctcattatctattttgttgtcttaggtgttcaaaacaaggtagaaagtgcaccgtccatatttagactttttttggttggcgggggtgatggttagggcagcgtttaaataacatgtttcttggtccacattaagagccgtacattacacttagcaggtgagactataagatcagagtctgtgggctaatttcgtacattagctgctatcattgtcttccacatctatttatttatttatttttgtcttctattctcttcccatgtacttgcttgtcaacaaaccccaaataaatgccacatattaagttaataaaagacatggtagttagggattgaaagtgtcagggtgaaaacactggtatgacaatccgccttcttaataaggttgttcttttgtaaacaatgttttaaaatctaactttatatgaatggttgattcaaagcctggtggccagtgttacagtgaatctccattcaccgtaatggagattcactgtaatggactcagttaatccagtcgttgaataatccatgttaagccttcactttttttctttttgggtgagcctccactcattgaaaacaaggtaaacttagactgaggttgacatgattgggtatctttcctcaggatctcccccttaagaaaggaaaactgaaccatcctttagaagaggaaatatgatttacctgaggaagaggtaatatatttctttctacactcagctgattgatcatggaataaaacagtatttgtagtcctctctcaggtagagaaggctcatgaagttgatctcctaaaagaaaacaatgctatggaaactaagtatgttttaatgtttaatgtgcatcgtatttactcataggtattcaaacaacatccctccctttagcctgaaatgttcccaggattgtattttatacactaggcacattgatataggcaaaggaatggggaaggtaattatccagcaatcagacatgtcaaccaggcttgtttggataactgacagcggtgaatcaggttcatcgcctctattgctttgtgggactttgtttctctttatagcatttccacatgtgttgaaacagggcctaaatgtaggtgttcaggatattaaaactagagctttctaaaaggactgagtataattaactcttgacttaagttccttctttaaatttcatttctatctgtggtttagaggcagtgggaggctgtgaaatggaaaaatggaccaaaataagaaactgaagtgaaatgaaatgactgaaatctgtttccccatagccagctttctggagcgtttcagcagcgccagtcatccttgcatacactgagtttctactacattccaggtgttgtaaaattttctttgagtggggtagaaagtaggagaataaaaatcaaagtgacgcctggtccagctctcaaaaacctcagattctaatcaaatgcagattcggtctgaatgtgcatcatcagaatgtaccaagggcccctatcaacgtgtatacagtttccacaggaacacagaggagagagcagctatctctgcctggaggagttgggaaggttccactgaagaggtggatcttgaagaatgggtatgagttcaacatatagagaaatgggatatgagactgaaagagcattcccaacaatgcacatgtggctgagaggaagagctcgatgcatacgagcagtagagagttttttcacaaggcaggggactcaggccacttgtatggatggaaaggaagggacttaagaaaggtttttaaggcaggaagagctggctgtctccccgagacgcttctgataagctgtgctaaagagcttggcatttagctcctgggttacagggcctctgaaaggttttaagcaaatgactaccctgaagagactctggtgggtggaaagacaaagcatggattggagtgagaattaaaggtggagacaggctcagggattaagggatggttcaagggagatacacggacctgaacaaaggtagggggcatggggatggagatgaaaggaaaccatcagaaaagaaggggccaaagagggaggttatcttggcagaagaaagacattattcatcttggttggttggaaatgtgggtctggagctcataagacagatcatggatagggatatagctcagggtctggggtcctgactccccctaagggtcttacctcagagagtgatgactgagcttctggaggtcttgaatttcctgaaatttatgtaaaatggaaggtgcatgtgtatacatttcctagggaataagtcaatagccttcatcagtttctcaaatggttggaaaatggaatatagaacagcaccaaaaaacactatcttaaatgaggatctatctacagggtgttaaacggaagtgagagtaacccagtgagcaatggagaggagagaaggtcccggcagccttgaggccccttcccccttaagctgagcactcagtgtcactcttctcagctccatctgactgtccccatctctaatctctccccatatgtacttcatatgaatcaaaggaaataacatagagagcttgtaaactctgaaatgctctgcaagtgtttagttatcatttaaaagatgaaatgaaatatggcaactccatttaagcttttattagttctgcccatctccatggaaaatatctgtgacattcaaaatgcctgttgatgctacattcactaatctttttattaataagtgagcatgtaaagttcacacacctcagacactaagatatgctatcagtacacatcgatgccttcctcctaattcagggctgggtaggatgggcctgagacaacacagatggatggccaatgactcagaggtggaaagtggaatgcaacccagcagtactgtgcagcgatgcagtcagatagaaacaacatctaacttttcagtgcagcttaaatgatgttgaattagccatggtgtggcggcacgattatgtctcaacatcactgtgctaaatctaaaccagaaggaagccctgtgtgcagagagcgatggtagcaaaaagctctattaagatttgtttcagaacagaaaagagtcaatatatactataaattaaaaaaaaaattgtcaccattgtagccgatgtgagaaattttggcatgctatttatagcccagattcccatttgaagtaaaatgcagtcagattgcaagaacagggttttgagccatagaattgatcatagagctgatggagccacatatcaagaattgttgatgggagtgggttctctgcatttagacttctgagatgagggataaggaagaaccctctaatccaggtgtctaaaatagccatgggtcatttaagaaaattatccaccaaagattccttaacaaatttttttctaaaggcgggtttaggcacatggtaggaaggaaaatcaaaaagaatccctttcttaaatgagttattaaagaaatagatttgattagaaatgaactcatgaaattaaaatgttaggatgattgaaagtagaacatcacttttttcttgtgaaggtcaaatgaggggtgtgcttgtgagaaaggaaaaagacaacagcaaggaaagcaaattaaaaccaacatcaggttgtgcaatggactaaatgtgttcccttaaaattcatatattggaatcttaacaccaatgtgatgggaataggaggtggggcctttaggaagagattaggtcatgagagggggccctcataaattagattagtgcctttttaaaagggacccccgagagctctctctcaccctgtctccccactgtgaggacacaaatagaaggcagctgtctgcaaacttggaagggagtcctcaccagaacccaaccctgctggctccctgatcttggacacatgcctgttgtttataagccaccatctctatgacactttgctatggcagcctgacctgactaaggcaagctgggagttagaactctcaaattctccgaatctcagccctgacattcaatagctgtgggtggcatgatgggcatggcactttacagatttgtttcctgacttttaatctaaacaagaaagagcacaaccactactgcctacctgagatcattgcacacaagtgttttataaactgttatataaataatttattttggcacaatcttgaaattttaaatgtctatatgaaaattttctctgcttgtcaccactacctcctgtccttatagaaacgtattttcatgagccatttggttcagagtttaaaagcagggagaataattattcaaccataattgatgtcaagcaatgttgtaaaatctcttaacttatcagagtctaagcactgttggttatgaaacccaaataataacaatgcatgtgaaagtgttttgtaaactttaatgctcaatgcaaatgtcatttatttatttcagtttctctcttactaaagtctgtttttctgatctttttgctgctggtatatttttgccctagtaagttcaaaaaaattaaaaagtcgtaattcttggcttcagatacctccctaggaattctgagagttttttttctatatagatctgcattgcctgcttgattccagcacatctcaactgggtagctcctacgccaaccatttatttcatgagcttgcatctcactctcttctcaccttctccattaacctttaccttggaaacgtcagatctgctcccatctaagccaaaaacactatccaattttatatccattaggtaatgccttgtgattcaaactacatctcaagattctccttgttgagaaagcttatctcaatgtgcttggaggggtgacaaggatgcaattcgttaatcattgtaactcttcatatttagagaatgcagcaattaaaaggtgcttcctcataaacatgtgaccttgtttgatcttcacttctataaagaaaaacatagtacctataattatttaacattattccatccattgtgcaaagtgagaaaaccaacaatgtttaaatccaataaagtccaaaatctctcagatgataagtaaaacagtgaagtttgcattttttctgtctacatctaagttttttttctttcaggattttttctttgtttttggttttctgaagtttgaatatgatatgcctacatgtgtattttgtttgtttgtcacttatcctgtttggtgtactctgtggcttggtgttttgcattacttttggaaagttctcagtcattgtttctttacatatttcttctgctccatcctatgtttcttctcctactagtattctaattacatatatattgcatcttttgaaattgtcccacagttcttaattgttctgttctgcttttatcattcttttttctctttgaatttcagtttggaaagttttcattgatctatcttcaagctcactgattctttctttggctgtgtctaatccactaatgagcctatcagaggcattcttcatttctgttagtgtttttcatttctagcatttccttttgatacttttctagagtttccatctctctacttcattatccacctgttctttcatgtctattttttccattaattaccttaatatattaatcagttactttaaattccataataattacaacatatgtttcatatctgagtctagttcttaatattgttttgtctcttcagaatgtttttttcttgtcatttgacatgtcttataattttttgttgaaagtcagatacaatgtatcgagtactaggaagtgaagtaaataggcatttagtataagaattaatggtcgtctggcagagaagttcgtttgtctttagtgtttgctatagttgtatgttacaaatataaatatagccagaggtttcagatttctctagtgtctttttctttgtctcatctcttacctttgggcttccctaagtactccttcttagagagagtttgtgtcacctctttcagctgtgctgtattcccgctgatgtgatggtaaggtgcaggggaggagaagcattctctaattttattaataaatctcagtcttttaatggggctgtgtcttggggctataaccgttacaagctttctcctttggtaccgtcccttccccctgcctcctactccctttcctgtctgcagcctccccaacccatttcctggaagccatggtccttgttgactatggggatcttttgccccctataaagtagacagaaagtttggggggtgctttccactggaatatgactctggcaaagtattttctcttggagcataggcctttgttgcagacacatttcacaaagattactctcccccttctcttgccaaaaccttgaagagatcttgcagatcttcatcttgagaacctgtgaatttcctaaaggtaaagccaatgatggtatggggtccctgaggactggggacccctggaagtttctgactctcatgctagtctacactcctggtttatcaaaatttccatttgagtgttcctatgagtttatgcctcatgtggcttctgctccaggtgagcagatcttggctatatttccccagatttgggggtggcagtttgccctaaagccacaattctctcgtggttccaagaaatataattgattttccaagaaaaagtccagcttttttgttgtaagaataaaattatgatttccaaagtatttacatgtcagaacaggagccagatgtcccaagtcatttcctttacctgagagccttcaccagcttctaagcaagaaaaagaaaaatctataaataagccaccatctacttgttgctattagtaaaaccatttttgtgttattagtaaagaggaaggaaatgctgatgtattgacttctctatctgcccattctctatggaggaggaaagccagcagaaaagtgctgaaatatctttgaggcataaaaagctaagacataccatgatgcaggagtctagcaatctgtccagcagaaggctcagtctgactgtggccatcaggggtgtcttaggagggatccaggcctccacagattagaacaacctccagatatttcccacttctggctagttattgatatgctgtccacaaaatcatggcaactcataaaatcacaaaaatttgcatgttggaactggaagattctcagggcttttttctttttctttctttcttttttttttttttttaacaaatgaggaaactaagtcccagagagtctggttcaaagccatacagttagctcttgacagattgtggggtgggtggcgggggagtgggggcagtctacacttttatcaatgccttttgctttcactctaaattacttttattttcattttattctaccctttggagcataagatttctatgtacttgtatatatacttttctcattagtatgttggctccctaaggagggtataaactggccctttatgttattactaaattcccctaggcatttataacgatgaaaaatgtcaaaaaaaaagaaaaagaaaaagaaaaatatagcagtgctgaagatggggaaaaaaaggtaggctacacttatttatttcccttccaccttgtcatctaggcattttgcaagcatatcacaacagtatacatctgatatatctgctgtcacctccatcacccttccattccacctgagatcgtgttaggaaaagaaatgaggaagacgtttgtgttcttcttgctcattgtttcaaatgatgagaaagactttgatgagacagacagaaagaagaatgaggcaaagcaagaataataaacccaagtgcaatgataaaaccaagtgtgcagtgggaaaatatgcaagactaaatctaaatccttcaatgtgagtcatctgaggatacctttgaaaatggtatttttatttggtttgtctgaaacattatgtagcttttgtcctgtgcttggttatctcagagtcttagctgtcagagaaggaagggacctgagagcctgctttgtttaaagttcctcgtgctgcactggaatccattcaatcaccagggaccagctgacttctgctgaacccaaccccatccacacccacccccagtcctcaacccacttactttacattccaggggtttgggtgttagaaagtcctttctcttgtagaactgaatatgatttccttgtaaatccatgaattggtcttaattacatcataaaataaatatgcttgacaattcagctattaagcaaagtatacattttgtattacttagatgaagtctttctgaggagaaatcttggacaaaacttgacagtctattcttttattttcatggatctccaaacaatatgaaccaaaatggctagcctgagtgatttaaggggttcagcaaattgacctataaaaaaaacggaggccaaagtagtttgaaatataggacatagaaatgtctttacttctccccaagtagtgaatgatcacaggtccctgtggggtactcagggcaggaatatgcccccaatttgtggagatgaaggatcactttctcatctagagtggtaaattatattaattggagaaagtggtgaattatattaaaagaggcatttccagttccaactcttcagatacacatggaaatgggcagttgtgagtatatttagagacaccatgttgcactagacgttagagaacgcgagtgtcacgttaaatggtgataggtgagactgaaattagttatctgaacattctctttttcagaaagatactggaccttgcattagaaaaacctggaaaaagttacaaggtatggagacattattgatgtcaaacatgatttcagacaggctgtttgttctaacctcagccaaactccggccccaccggggaggcagcaagcagatagcaggaggaatgtggaagagagaaaggcttacggaaaatggaccaaagaggaaacaaggcagaagttctccatctcttttgattggggccaactatgagaagagatagccccagtgagaaaaagtgagctctaagctccagggatcagcagggagccatgaggggaaagttttagtacctgagctctgtgtatatacaagaaaatgcaaatacaaattgagcaccaagaaattacacatctatacgcagaagggataagaaaaaaaggcaaatttacaatgtgacatcactaattaaaagaattagggaggggcaagagggatcctactgtagtagatcccagactttttgagtttattaatttttaaaactagaatgttgagttcatttgtttaaaatattaaatgtaattcaaataatggtatcttagtgattattcaaaatcaaaattttatttgtcaaaaagaatgctgaaaaaggtcatattcaaaggaaataatgattatatgactaaagatagtaattaatttctcaggaaaaaaatgatccacccacacataaaatccttcatctttgtagaaacttatttgaggtaaccctattttgctcccttaagctcacctttgattgaacaaagtaaaaatagtctttctttgtctatgcatttactttaataaataggcatctagaaacatcagaggcaataatatatcaaaagctaactgaattccaccaagctgttttgaaaatgggatttctccatcttcgaattttcaaaagcaatttatctcctccacaggctgacaaaaaaggaaagtttttgatgccttactctgagggaaaatttcttgatttcaaatatgtaaggaaaagagttctctgcatattttatcttattgtatatatatatacatctatcactttgtttctttgtcaacctcatagccagaattactgactgatgatcatttgatgtaccacactaatttcagtgagagttgtactgagtgttttatctcataaatatgtttataatctctaataaactaggtatgcaatttcttagtgaattttcaatggtaatgcaaagctaaatatcaattaattaaagagttctgggggtggaaaaggggacaagggaaaggaaccactcttggttcttacaagatggaatttgcaagagaacttaaattacaaaggaaaaatggcattaaattaatatctaatttctaagctagttgaccaaattatttgaggcttattggcgttctcttgcttagtattgatatagtacttacttaacttgctatcaccataaacaaaaacaaacaatgatgacatgctcttcaaactgaaaagctgcaggtagcattccccaccttcaatagtagctgcctgaatctgtgtctctccatataacctttgaaatcaaaccgttcaatgaggatattaagaaatatcacccctaaccctcatgtacaacaaaactggaagacaaagaatagtttagactctaagtgtaatgggaagaacctctcaaaccagcagaatcagtttcagactcctgactaaagtctctctgatggacaaggatggaagaggtgtgactgcatttgaggatgtagcagggaggaaaagaaaaagcacccccccaagaagaataggggtggatctcaggagtgtactgagatgggacatagagaacagggacatgaggcctcagggatccactggctactgtggaattgaaagaaagaggcttgatgtttcaaaggaccataggtgtaagtcttctagtaaagaagcaggcaatgtggaggcttgctggtaaaggggaaaagatagcaaaagctagaagttataggaagaagtgttatacatcaggaagcactgtggccacctccacacggtagaagaaagcaacgaaaaaatataccccacttacaagggcaacaaaaaaatataaaatacttaaaataaatgttgtggccaggtgcggtggctcatgcctgtaatcctagcactttgggaggccaaggtgggcggatcacgaagtcaggagattgagaccagcctagccaatatggtgacatcctgtctctactaataataaaaatattagtcaggcatggtggtgcaagcttgtaatcccagctaatcgggaggctgaggcagaagaatcgcttgaccccaagaggtgaagttccggtgagccgagatcgcgccagtgtgctcagtctgggcgacagagcaagactctgtctttaaaaaaaaaaaaagttgcaagaaatgtggaaaaaaaactcatgaataagccttgaaaactctcctggaagacccatgatcaacttgaaccataaggaaaatgccccttgttcatggacagaacaagtcaacattataaacttgccaattttcccaaaaagaatgaataaacaatacaatcacaatgaaaatagcaagaagtttgttttttccccctcgagctagacattcgattctaaaattcacatgaaatataaagatgggataatagctaagaaactcctgaaaaggaagataaactgggtggggggcagccctaaccctatcaggtattaaaatatagcattgagctgctgcatttaaacgattctggaaatgttccatgaatagacagaccaatgaaacagaatagaaagtagatccaagtatataaaaaatttgtgtttgataaaggatgaatgcatcctttgttatacacagactttcatttgggaatgtataaatttgggggaataatgagctttcattaattactgtagaaattatgaactttcattatttattggggaaattatgaactttcttgtaaataatgttgaaacaattggtttcatttgtaagagaaaaacgtggacccatacttcacattatacttaagaggaaattctaaaagatctaatatataaatgtaaaattgaaaccacatagtactcagatgaaacaaaactttgaagggaagaaaatactcaaaatccagagacaataaaaataaaagaaagaattaataaattatattctctgtgtgtgtgtgtctgtatgttttaatataacaaatagaacaggaaaaataatcaaagctaaaataaaagaacatgttttcacctgaagaatttaaatctgtgaatcaaaatacttcatctattatcagttgactaaaaccatagacctggacacagttttgtaaaatttataaaagctcactccccaagtatttcagcagaaaagtcaatctacctacaatttaataaaaataatatttgtctcagacttttccatagcaatgaacatcagatataaataaaagtaacatttacagagatttaaaaaagaaagattgtaacccaagaatataaactaaacaaattttcactcatctgtaaaggtcaaagtaaatagtcaagtctttaggaagtagttcacttccatgccattttggagaaaaataaaaaaataataattgaatatgtagtacatcagagcaaagtaaaaaacttggtaatatgaaaattgtggtaaataaagaacattcaggttcatttttaaaagttgcaattattgaaaatactcttgaaaccatagggtaaatattttgaaaatgctcctgaaaaagaagagtctccagtctttccctctgtctctcacaacacacagccacaaacacacttacgcacttttaaaatattagattattacaaccaaagttaaaaattagctggagaagaaggccaaggaataaaaagcagccagtttcctaattttctataaagaagcatcaatagaaactgttttatgttggcaatactaattagataaatattggttcaagtgcatgttctcagatttgaagaaacttatcagataattaaaaacaaaatatacctctttctagttattagaagtacaaagacattaaaaataatcaacttacaaaaagcggaaacaagaaaataaaagcacacaagcaggaaaataaaggtatgaaatgctaactccctaaagtctattattttctcatctataaaatgtgggttataacaaacctaaccataggttaattttgaagattaataagataatgttcaaaaagtatttctcagtgtctggctcacaatcgaagctcaaataatgtttattattactatttataataaaatatgacagttatcaattatgaaagtaaattttcatagttaaaatttaaataaaatattaaacctttcttattaaagggaaaaattaatacaataaataaaataacaaagagaattaaaaatttaggcttgtgaaaaggtatctcaaacaacacaaatcaaaagaaagtaacagtgtagaattccaagtaaaaaagcattagatgatgcaaagatggtcattttatatggatacatttttaaaaatcacagtgatgataaaattgtcataaaatttaattaattaaacatttatctttacaataaataaaagtatttggaaatacaagggataagaaataatttttaatgctttgctctcagtatttataaatcaagaagaccaaaaatagggcaaccctcttttgggccccctgtccgtggtggagagctttcttcaattgttcattaaactcttgctccaacctcaaaaaaaaaaaaaaaaaaaaagaagaagaagaagaaataatataaatcaagatgaccaaaaatatacctaagatggtagaggactttaataatgtaattaattagatttaattagtgtatattaaacaatatacctttccaaggttttggaaaaccttaacaaaaactatatcttatgtagtctacaggatttaaaaaaattttatttgtatatgacacactctatcatgactatgtaataaaaataaaaactaatgggaataaaacatttcaaaaaatccagtaattttagaataaaaagaaaacattgtaaatattagctaaaaagaaaaagaaaatgaaagttactactacaaaccatttagaaagtaatgaccatgtaaaactatatgttaaaatttctgtaccaagacaattaaatgggaaaagaaaaggcctttcagcaagtggagctggaagaactagatagccacacaagagagaatgagttgaagtcctatctcacatacaaaaattagcaaaatggaggagctaaaactctaaaactgttagaagaaaataagcataaatcctcatgatcttagaatagacaatggtttcctagataagacatcgaaagtataagctgcaaaagaaaaaaatacaaaaattggacatcatcaaaattaaaaacttatgtgtttcaaagaatgccatcaagaaagtgaaaggaaaatccacataatgggagaaaatttttacaaatcatgtatcttataaagcaggggtccccaagccccagaccacagactgtaccagtccctggcctgttaggaaccaggctgcacagcaggagatgagttgagggaagtgagcattactgcctgggctctgcctcctgtcagatcagcagcggcattagattctcatggaagtgcaaaccctattgcgaactgtgcctgcaaggtgtattagtccattctcatgctgctatgaaaaaatacctgagactgggtaatttataaagtaaagaggtttaattgactcacagttcggcatggctggggaggtctcaggaaacttacaatcaatggctggggaggtctcaggaaacttacaatcatggtggaaggcaaaggagaagcaggcaccttcttcacagggcagcaggatggagtgagtgcaagcaggggaaatgccagacacttataaaaccatcagatctcatgagaactcacttactatcacaagaacagcttgggggaaaccacccccatgatccaattacctccaccgggtcttacccttgacacatggggattacagagattatgtgaattataattccagatgagattttgggtgggggcacagccaaaccatatcatgaggaatcaaggttgcacactctttatgagaccccaatgtttgatgatctgaggtgcaacggtttcatccctaaaccgtgcccctccccctgcgcttcccaccccctgttccaattttgtgaaaaatatctttcatgaaactggtctctggtgtcaaaaatgttggcgaccactgttacaagggactcgtacctagaatatgtaaagaattattacaactcaataatagaagggtaaataactcacttttaaaaattagcaaaggatttgaatagacagttcttttaaggagatatacaaatggccaataagcacatcaaggattgcttgacatcatcagccatctgcaaaatcgaaatcaaatccacaatgagataccacttcacacctgtgacgatgcctataacaaaaaagatggataaaaacaggtgttggcaagaatacggatggagaaactggaatcctcatacactgctgctatgaatgtaaaatggtgcagccactttggaaaacagggtggcaattccactcccaggtatataccaagagaaatgaaaacatacatccacacgaaaccttgtatacaaatggccatagtagcattgttcataatagccaaaaagtggaaactacccaaatattcatgaactgatgaatggatttaaaaatgtggtatattcttataatgaaacatgcttccgtgataaaaaaaaaaaaaaaagaaatgaagtgctgacatgtgctacagctgagacaaatcttgaagacatgaagctaagtgaaagaagccagtcacaaagaaccccatatggtatgattctgtttatattaaatttccaaaataaaggaatttatataaaatgaagtagattaatgcttgccttgggctacaggggctggagcaattgagggtgatttttaaggggtgcaaggtttatttgtattgtcatgaaaatgttctaaaattgattgttgtaattgcagaactctgtgaatatactaaaagtcattgaatcatatactttaaatgggtggattgtgtcacatatgaattatttctcaatagagctgtttaaaaaaaaaaaaacaacttgttggccgggcgcagtggctcacacctgtaatcctagcactttgggaggccaaggcgggcggatcacgaggtcagaagatcgagaccatcttggctaacacggtgaaacaccatctctactaaaaatacaaaaaaaaaaataaaaaatagccaggcgttgtggcaggcgcctgtagtcccagctactcaggaggctaaggcaggagaatgacatgaacccaggaggcggagcttgcagtgagccaagattgcgccactgcagtccagcctgggctacagagtgagactccctctcaaaaaaaaaaaaaaaaaaaaaaaaaaaaaaaacaacttgtactatgacttcaacttccaagtggaatgtagatgttgtgattgcccaatgttcccaacacaattactggacaaaaagccagacaaatgaccaaaatcttgtttcaagtcgccatacagttgtagaaacaataattagatgaactggaatttcacaggaggagacttctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagatagtggatttgccacagtcttccatgtttgagggagagtgacccactagtctctcagcccaaatccttgaagggtcttccttgagaaacagggaaggaccaaagatggatgagtcttaggaaaactgcatatgtgtaatagaactaagaggggaagcgggagagagacaatgggccaaaagcaacaactgaagatataatggcaaagcatttgccaaaatggataaaatattaatacatcaattcaaaaattcaagaaaccctaagtagctcagcaaaccccaagtagggtttaagaaaaaagaaaatcatactaaggtacattacagttaaactgctaaaacttagcagatgagctcaagtttcttttctgaagcaaattcatatccttaaatagccttattaaataataaatatttaaaaattttaaaactacttattcatcataagaaattaagaaaataataaaatctaagattcacaggagattgggttaccaaaaataaatgctgaaattaaattatcaaaaaaagggaaaacagttaaattgataaattaataaatcttaaaggtggttattttaataataaaaacccaacaaaagacgtgtatttactttcaatgtttattattttaattaaataaatttgattcaaattaaaaagcacaaatgtgagagtgaaaaaatgacatgactacagattcaaaggaaactacaaaaataagagaaactgcaaaaatatgccttccataaataaatttgatagttttaatgaaaagtataatttctggccaaatataaattataatattttacttaagaagtagaatatctgaataggcctattactatgcatattactaaaaggattattcagaaattttaaaatttactacaagattttacaagattaggttgtatcacataaaattactttatgctatatataatagagtacatatgcataataattggctatatttgaatctcaatttatttttgacattaaattaacttgttaccaagcttgagaaagcactacaaccatgcaactaaaaaaatagcacatgcgacactctcacttatgaatataggtgcaaaaattctaaaggaaattctaacaaatcaatttcaatgctaaataaaaataaggccataccattttaagtagaattattctaggtatgcagacttacttcacactaggcaatctatcagttgaattgatatagctacagttcaaagggaaaactacacaattatttctacccatgctgaaaacacattaataattaagatacatttaaaaattaataagctttatgttttagagtagttttagctttacagatatattgagtagaaaatacaaagttcccatatactccctctccctaccacagtttcctctattatcaatatcttgcattgatgtggcacatttattataattgatgagccaatattgatacactattattaactaaaatcaataggttactttaggtttcactcttggtattgtacattctagggattttgacaagtgtatagtgatgagtacccaccactaaagtatcttatgtaataatagtttcactgccttaaaaatcccccttgtactacctattcatctctccctgtcctccagtccccagcaaccactcatctttttactgtctccaaagttttgccttttccaaaacgtcatagagtaggaatcatacaatatgtagccttttcagattggcttctttcacttaacaacatgtgtttaaggctcctccatgtctttttgtggcttgacaactcatttcttttcattactaaatagtattccattgtatggatgtggatgtaccatagtttatttgtccagtcacctattaaaacacatctgggttgcttctaaatgtcggtagttaagaggaaagctgctgtaaacattcatgtccaggtttttttttctgtatgtaagtttctaattcatatgggtaaatatgagggagtgttactactgagtaggagtatgcctaattttgtaagaaactgccaaaatcactttccaagtggccataccattttgcattcccactagcaatgagtaagaggatctgctgcacaacattctcatcagcatttggtggtgtttatgtttgggattttggtcattctaatgggtgtgtagtaatatctcgttttaatttgaaagtctctaatgatgttgagcatctttccacaagcttattttccatctgtatatcttctttggtaaggtatctgttgagatcttttgcctattttttaattggactgtttgtttcttactattgagttttaagagttctttgtatatcttaaatactagcctgcatctgacatgtgtttcacaaaatcctcccagtctatggcttattttttcattctctgaacagtgtcatttacagaacagaagtttgaaattttaacaaagtccaacttatcaatttttttatggattgtgcttttggatttaagaagtcattgccaaattcaaggtcattgaaatattctcctattttaccttctcagcattttacaagatatatttttaattaaaaacaaatagatgctctgaatcagtcatggtccccacaaggatttttaatagaaactgtaaggaaaagacaacttacaatgggcttggtaaggttaaggaaatatataagggataatgcttgcaaccatgataagctgtcatcacccaggtcaaaaggaaaaaagggaggagctagtgctgggacccagtgtggaggctatggtgaagaagctattattgtgaactccactactactataggtttcatacctaggcaagaagagcatgtagtcctcataagttgatagatataagaaagggggctgggcgcggtggctcacgcctgtaatcccagcactatgggaggctgaggctagcggatcatgaggtcaggagatcgagaccatcctggctaacacggtgaaaccccgtctctactaaaaatacaaaaaaaaaaaaaatagccaggcgtggtggcaggcacctgtagtcccagctactcgggaggctgaggcaggagaatggcgtgaacccgggaggcggagcttgcagtgggtcgagatcgcgccactgccctccagcctgggcagtgagagcaagactccgtctcaaaacgaaaaaaaaaaaaaggagccctaactggcaggaacaggagcaaggatgggggagagccatcattctaagaaatggctgacaagccatcgttctgagaactggttaaccaacaacaacccacttgcacaacaccctgttcccaaataccttgttttgcacatagacccagcagcatgaccttatcagcacgtaccctctccagcacaagcctataaaacttccctccagcccctgactcttcgagacaacctcctctctgctgtgcacctcattgttctcttgcagtgtatcttcgtactttctacaataaatctgcctttctttatccatgactgtcttggtaaattctttcactgcctgcaatgctggacccagccagtcacaccagcagcattttggtggtccatatggagacctctcccctgttcactgttttttctcttctccaactccaacctcttagtggacagcatccaagcctggagacatctgatggccccccactgcagctactccctggtggatcagaaggtcccagtggaaagaagtttgaccgtcactgcccgatcgagtgagagtttagagtttactttcctttcccgtcttctggtggacaaactctagtatccctctagcagctgatggccactggccagggccattccctggtgtggcctaaaggccaaggagtgaaccaggtttggctgccttgcttggaagggaggatggctctctcctaacccttctggtcaaaagtccccagtccctacatgcagcacaataggcagcggcagcttgaccagggcaaacgcacacacattttggggaactcagaccccgtccttctcactctaaatttctcctgtgaagaaagccagccatccttttctggacattttaagcaacatgatcccaaatagcaccagaacagtgagccttccctcaacctttgccccttatacctggattcagcacccagtataattcatacgtggactgacctggggctgctcaccctgtgttcatccatccagtgtaaggctctcatgctgggaggtcctttctaataggtgggatgcccctttggaaagtgcctctcaaggctcctcagtggacataagtggaaccccctttccttggctggaggccccaagagaaattgtggtttgtgtccccagtagacattattttccaatccccccatgggacaaagcccttccattctctcagactcaccgatgggctgcattctaaaacattgggataaacttgactcccagactctcaaaaggaaacatcgaattttcttgtgtaatacagcatggccactttataaacttccagatcaggaatcctactggcttccaaatgggacctctgcccccagtagtattttataggttgacctctttggtcataattcttctaaacggcttgagattccttatatctgaggttgtgtaactctttctaagtttgctctcctctcccttacatggttccttcctttactaggacagctgcatttatacttctacttctcctcttcagtcctttgtctctttaatttactggttaaatttgtttcttccagaatgtagcaattccacagcaaactcctaatgatgcaaggatatcagccaatcaccctcagaaaaccccatgaatctcctctagactcactagatatcaattccatattaacacgctctttcttcctgagttctatcctccagcagcatttaatagactaagtcccataactcaggacaataacccacagggtcccctaacagaccaataatcacaggtagggcccacactgtgcccacagtcagcaggaagcagttggaagataagacctccataccaatgccaaagatttgtcattgttgttctgtcagcggggaacatggagtcctggtaagttaatagatacaagaaaagggctctagctggcaggaacaggaatgaggattggggagagccactgttctaagagatggctgacaagccatttttctgagaaacacctaaccacaaacaacctacttgcacaacatcctgttcccaaataccttgttccacaggtagccccagcagcatgaccctatctgtacatagcctctccagcataaccttatcaaacttctctgctgtgctgcctgttgctctcttgtatctttgtactttctctaacaaatctgactttcttaacccacaactgtcttggtaaattcctttactgcctgtaacaccagccccagcctatcacacctgtgacagatggagaggatgaagtacctttacttctctctcctcaccctcaatagcatgccagtgatccttgctggccaaacacaatcagagggcagccagcaagggagcctgggggctgctgtctgcatgggtgatcatcctggggcacaggcagagccaacatgagtaggctatccctgtgagagagggcacatggagcatgaggaccacagctctttgtgtaaccaaaaattagtgttccacactctagactcttgcagaccaagggttgaagctgagctctagcactcattggaaagttgatgtctttaagcctctgcattttatgtgtaattaggattaataacagtgctacattatagatattaagatgactatttatattaaatgtttgtgaagtattaatgagtgcttagtaaatgctagctgctatcactactgctgccactactatcaaaactactaccattactactactaataacataactactattgtcactactattaccactaccattagtactaccaccactatcatcactaccatcactactaatactatcattaccactactattaccattaccacgactatcattactactactaccacctccaccattactactactaatgctatcattactactactgcttctataattactactcctactcctaccattactactactagtagtatcaccattactactactactatcattactattaccaccaccattactactatcattactactactaccaccaccattactactactgctgtcattactactactgctactatttactcctaccgttactactactaccaccaccaccattactactactatcattgctactattactactgccatcattactattactactattagtttagtcattattatcagaggcgaggagaagcaggcagcataaccaagaacataagtattatttctcaatatgagacagaatctctatattaaattaatagccaaagccatacccaggaatgaaatatttacatgttctcactgaaaccaagaaccaaataaccagaggattgctaccatcattatcattgaatgttctagaaattttagccaacatattaagatatgcaacattaggaaagagaaaaagtttaccttttttggttaacatttacaaaatatgatggttctctgccaagaaaatcactccccaatttaaaaattaagtggctaaacacaaaatgaatgtataaaatttaacggttgttctgaaaactaggataaaactattcataatatttaatgaagataattttccacttacaatagcaacacaaactattaagtgcctacatagctttatatataattttgcaaacaatataaaggctagtaaaaaataaaaacaaaaaacttataactacattaagaaaactgggcacagtggctcatgctggtaatctcagaactttgggaggctgaggcaggaggatcgtttgaggccaggagttggagactagcctgggcatcattgcaagatcacatttttacaaaaaaaaaaaaaaaataggcacgcatagaggcatgtgcctgtagtctgtttacttgggaggctacaggtagctagactacagtaatggtagtagtagtcatggtagtagtagcaaaaatgacattggaaaaatgtcgattttttccaaattcatttataggattaacacaattgcacttaaacttccactgagatttattattaaatgtgttcaagtaaaactaagattcatctagaagaatgaatttataagtagagctcagaaaaaattttttaaatgcaaaacagaaaagattaaccagtgagatttgccctgttatatatagaaacataacactaatatagacaaaatatgtggttttggcacaagaatagattattggaacaatgaaatgaaacagaaactctgggaaaagaatacctacattaatataatgaagtaaacccagacatgtattctgacacattacccccaaagaaataccaggtggattaaatatttaaatgtcaaaaataagccaccataaaaatcttagaagaatatgcagcagaatatttgtgtatctcacagtgaaaagagggttttacaagtataaaggtaatacaaaatagaacagaaaattgatatgacaacatgaaagaaaaccttttatatttcaaaagtcagctttcagtttttcccagtaacagccattgtttataaccttggggtctaagtttccaggcttgtattggaacaggattagaaaaggaattatactatacattgggtgactgtgtcatcaccctctaggatgatttcttcttggaatgagacttaagataccatagttctactttcattgtgcattgatacattaagtcatttataacatttcccaaaactccaatctggagaactttctctatcaccagggcattgctttggaattcagggaggcctgagttctggatgggaatgggagtgagatggtccagtgaatgttaacagtcactattattatccttattttacagaggaggaatattctgctcctttatgagccaacatttactttctctgaattaaatgttactggtttcttatttatagacagcagagattgactgggcacactttcccccacagtttccaagactctgtaattatatgcaaaatagtaaaattaaattcaatctagatgaatccatatttcaataaggatattagtgacttaggtctaaaaattaaaattagactcgtcaatcctgttatgctttccattcaaatgtttttcctaaacagcaacaacaacaaaaacctgatttcctaatagtccatttagcttttatttcatgccatttacaaagtttaggcaacataaatgcactttatgcatatctctgtcccatatctcagtctagatagttgtctagataattttctagacaacctagataatcaatgggaaggctgaatggcagagcagaaaaaccatgtcttcagggtctgaactattgagagtaagtatcatctccaccacttaacaactgtacaactctgggaagatgtgctgggcaagccctttcagtcttgttggcttacccagtagtcaggatttgttgcaagaatacagtgccagctgtgttccagccactgctctcagggtactgttccctttccctttatatgttctgatatttctcccatagctaccaaccagcccattcttccagtctttctctgttcagatgctaatgggagagagttgatggtcttagatagtcaccataatccctttagagcagagatttgttgtagaagccaggccactttgaaggacacaggctgcctgatattctggctgcccttgggtcagatctcatccctggccaaagtggtgccaccactttctcaatgattgcttatttctccctccttcaacatgctttagaaggcagcgtttcccttagaggagcacagtgggctgggcagcaacagtggatgacgtgcgtattacggcactgctgggtatcatcataaccaacatgaacttgtggcttgttcttacaatgcgccagacgtctcatgaaacattcaacgtttcttaattcaccctcacaaccagaatgaggtaagtgttgttcttattcttattatttgatattttatagataaagagaagcttacagcatgaaataactttctcaaaatgataagatcagtaagcggaatattcttttttgtttttttttttgagacggtgtctcgctctgttgcccaggctggggtgcagtggcccgatctcggctcactgcaagatctgcctcccgggttcacgccattctcctgcctcagcctccccagtagctggaactacaggcacctgccaccactcccggctaattttttgtatttttagtagagatgggatttcaccgtgttagccaggatgatctggatttcctgacctcgtgatccgcccgcctcggcctcccaaagtgctgagattacaggtgtgagccaccctgcccggccagtaagcggaatattcaattggattccagagtttatgcttttagctatcaagctatactctttctcactatatttccctgagctttggtttccttatctataaaactggaaccgcactgcctgtttgcctttagagctataggtaataaatgttatgcatttattatggtaaataacatgtagtagagcaaagcatggaaattcaggaagtaacaaagagcagtcataagaatgtctatgtggtaaatctagataaaaattacttgtatacacatttacagtagcgcctttaaaacacacaccgatagcactttagtaagtcaagaatgcatgttgcaccaattagagaaaacaccaattttttaaaaaaacatataaataacaagctaatagaagaagaaatgtaattagaaaaatttaaataagcccaaaaactttaaggaaggacaaaaaaaatcatagaacagagaaaataggaatcaatggtaagatggtagatttaaccttgaattacagtaaatataaacagactaaatattgaaattgaaatataaagctcatcagagaaggtaataatatcaagcaaagctaaacaagctgcttactttaaatataaagatatcgacaggttgaaagtaagtaagggatggtaaaactactatgcaaagcaaaagttacaaaaccaaagcaaagactggctcgtttcagaataatcaacgtttcaggtttaatatgaaataatcgtaaatttgtttatacctaataacatagccataaaataaaaattgacagataaacaatcatgttaagagcctgtataagccagatttctccagaaaaacagaatcaaaaggatatatacattaagaattatattaagaaatttattttagcatattggcttacatgattgtggggctggcaagtccagaatccgtaggagaagctggcaggctgaaactcaggcaggaaacgatgttgcagactttaggcagaattttttcttctctaggaaaattcagtttttgctcttaaggcttctgattgtataaggcccattcacagtatgaaaagtaagatttatgtaaagccaactgattgtagatgttaactacatctacaaaatacctttgcagcactacctagattagtgtttgattaaataaatgggcagtaaaggccgggtgcagtggctcacgcctgtaatcccagcactttgggaggccgaggcaggaagatcacttgaggtcaggagttcaagaccagcctggccaacatggtgaaaccccatccgtactaaaaatacaaaaattagcctggcttggtggcgggcacctgtaatcccagctacttgggaggctgaagcaggagaatcacttgaacccaggaggttgtagtgaaccgagatcgcgccactgcattccagtctgggtgacaagagcaaaactctgtctcaccacaaaaaaaaaaaaaaaaaaaaaaaaaaaaaggcactaaagcctggcccccatgatgacacaggaaactaatcgtcatggagactttatccacacttttgaatatatgttacatttcaacattaaaacacacacacacacacaaaatcataaagcaatcaacaaaattaagctgaatgcttcgtaattgctggattccctgggaagctgactctgagatggagattagcgtgcaggacatttcttacgggttgttcttgggatcaatacctgtggagaggagaagctgaggcaggatcaggaagcggggaagtagagtgcaatgctggtgaagcggcatcactgtctggggtaaatatccggggttcatcatctctcgtcaagatgattaacgacatggacacacatgggtgagttaagaagcggaaagtttaataggcggaagaaaagagtgaggagaccagctctcagacatccttaagggaaaggctggcccgtgactgacggcagcaggttttacgggcaggcttgaggaggcggtgtctgatttacgtggagcccagagattggttcgaccaggggtgacgtttacgtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccaggtagtgttttttgttgttgttgttgctgctgttgtcgctttttgagtcggagtttcgctcttgttgcccaggctggagtgcaatggcgccatcttggctcaccacagcctccgcctcctaagttcaggcgattctcctgcctcagcctcctgagtagctgggattacaggcgtgagccacagcgccggccccaggtagtatatttttattggcacaactgccggtatttgcctgtgcaagctttcagcttgcttgtctgtgtctgcagctcgattttccaggttgctttttgttagaaaagaaaatgatttgggggctgcttttcattaaaaggaagaccttactgaggactcccataccttcactatctgcctaagtactttcttcttaactcctatatcactgggtcagcagcaaccccagtcaaacctcaagggagacgggaagatgggacgatctgtcagaggtatgctgagttgaggcaagagagctgacctttatggattgccaatcagtgactcattggaagtggggcaacctggaaggaaatgtggccttaggtgaggcagctgtcttcagaggaggcaatttctttgtatctggaggggcaattgttagtgttcccctggactgaagggtgaattatggagaatggaatagaacgatttgttactatgatttggttgatgacttatttcctgtttccttagcttcatcttgctgagcaaaaatgaaggagcctggacccaactttgttactgtgagaaagggtcttcattcattcaagatggcatttgttaagcacctactgtgagtagatgatctcctgtcaaagacagttaacaaatcctcggaatattgcttcatgtacagttattggagatgagtaacttacattctcttaattgtaatggttccttggaaagtcatcgtggaaaatgaaggctggctcatacattttcccagacaggaatttggctgccaacagggaattctaaacaactaaaaactccagatgatgaatgcacaacataatgatggttaaattaaaaaaaaaaaagagcacggtaataaaatttccatgaaatattttgtgtaagcgcagataatcagtcattttctttatagaattcttattcgtaaataatttagaatactttgttctttataatatatgatgggcaactatagtatgattcttctgagtgactcagttcttttttttttttcacatttaatgactttgtttctcctaagtgaatgcacagatagtatattaatcagggttctctggaaaaaccagaaccaatttattatcaggtactggttcatgtgattgtggaggctgagaagccccatgatctgctctctgcaagctggagacccaggaaagctgatgaaagtcaaaggcctaagagctggagggccgatggtatagattgcagcccaggtctaaaggcctgagaaccagaagcacagagggcagaagatcaatattccagctcaatcaggcaaagagaaaaagtcctcccttcctctccgtttttcttctattctgaccctggatggactggatgaggcccagccacattgaggagagccatctgctttaatcagtccaccaactcagatcctgatctcttccagaaacaccttcacagatacacccagaaataacattcaacctgttaggagtatcccatggctcagtcaagttgacacacaaaactaaccatcacagatacacatcaaagttaaataatattaacacagactttggcaagctgtattttaaaacacagtaggttagtgagtctggtttaagagcactagatgaaaccacatataaggatgtttttgacattctgtgtctgacccttcagactccctgccctcctccccaccatgttctgaaccccagaacactgacctctacgaacagccccacatgggctctgttaccctctggcttcccattggcccatggaggcacagaggaagttggggcaggaggacagaatggttgaggtacggatgctcgagctctcaaggccacaagtcggcaggggctacattcctgtgtgaagctcactacccctcagtcgtctcctctagctctctgtggggtccggtgacctctctccttacagtcccattagccctaggggaggtaatggctctccagggagtgctgcccatgggtgtctcagtatcacttgttggttcccatagccccacccacacctgtgtaaataggccttcattaaccttagctcagttgcctggtttgagtgtaccatctgtttcctgccagcactctgactgataacagcatttttgatataggtctccatcacatgtatgtacctttgtgtcctctgtattcctcattgatcagggttataaattttctcttcctgtgacactaaattgcccttaataaagcttattgaccctaaaagtcaaagggggcaaaatcagagctagtctcaattccttaaagtggacattatacagaaggttaggaaatattaaatacaagtattcacatatgtgttccccccgtcaagctaataaacatatgtatgtgctttttgaaaaccagtgtaaccgcaggttgtctcttgttcctagtaggtgctgattagagcaatgagttccaacttggcagtttttggaaactgaacatgagctgttaatgtctctgcatcaactcgggtttccttttgcttttgtttaaattgaagtttttcacttaatataagatttagagatttctgtctcagagctcgccaagatttgctacttttgtctacccttgtttttaatcttaaaaatttggatttacttaataattccaagtatgaacattaatgttgcttttatcttccattttactgcacaggaggaggggaacagataccaaactactgattattttacttccattgttaatacacatgagaatataagtcttcttgtgtacctggaacttacaaaaattggtttcagctactcaggaggctgaggcaggagaatggcgtgaactcaggaggcggagcttgcagtgagccaagatcgcaccactacactccagcctgggagacagagcgagactccgtctcaaaaaaaaaaggaaaaaaaattggtttttaaaaaattacataacatatgtaatttttaaaacatatgttttaaacatatgtaattttcaaaaaaaaattggtttttaaaaaattacataacatacttatgttaaaatatacataacataaagtgtatcattttaaccattttttaagtgtacagcctaatggcattaagtacatttgcattgttgtgcagctatccctaccatccacctccagaacctttttttatcctccaaaattggaactgtgtacccattacacaataatgccccgttctcttttcctgtaagcccctggcacccaccattctgctttgcctctaggaatttgactactctaggtacttcacataggtagaatcatgcggtatttgtccttttgtgactggcttattccacttaccataatgtcttcaaggttcatccatgttgtattaatagcatgtcttggaattcctttccgaaatttctaaggctgaataatattccattgtatgaacagaccacatattgtttttctgttcatctgttgatgcaaacttgggttgcttctaccttttggctgttgtgaataatactgctgtgaatataggtgtacaagtatttattcaatctttgcttgcagttctttgagctatatatgcaaaaaatgggatcctggattatacagcaattctatgtttaattctgtggaaccaccatattcttttctgtggtggctgcaccattttatattcccaatagcagtgcgcagaagtttttccacatccttgatagcacttgttattttctgttttttgttttgttctgatttatcttttgacatggaacattcttatacatggttacacatccattatggtggtcttcatcaagttagaggctgcaaagcatccatatcattcattcttctagggttaaaggcatttgtaaaatatcaaattcaataacactgctaaatgtcttaaactttgtgtgtgggagggcgtaactactggattttataagtgcttattacacttgaagatgacagatttcttttctattgaacattttaaagaacaatttagttcatcccaactgatattttctgaaggccgctatgtaccaggttctgttacaggtgaatggacccatcagtgaacaaaaccttaaaaaaattacaaatcatttggaaatccactattacagtggcttcttcagggatgatactgttttccaatatgctacctaggaaatgtgcttctttccaaactcactgttatgtctcaagcgattagttcatggctcagaagaaacataagtgagaggtgctccttctacagcccttactttgtgcttgtttctggcactcaccactttcgaccttgtcattcgtgtgcttgttttattttcttacaagactttgagtttcttgacaggatttcatctgtatttgattttctacaattatctgcagcattttgcatataagcattaaaaagatttatttcatttgctgaataataatgaacatggctgttttgtattctttttatgagatggtcagtcacatgcagccacggaggagacacaggggaggctcaggaagacagagtattatactcacaggtcctacaaagaggaggcacgccatgccacgcaggaccacacgggaaaaaacaccagagtggtcaggaggcaggaggcaggagctcaggaaatcattcaacctttactgaggtttcgcgggaaaggcaggtgagcagcttaggatgggctagtttgaatcatcctggtgggctctaagctctagggatggccctagttgtctagtacccagctctggaatggttaaggcagaaattttaaaaaatgaaaatttaaaaaatatatatgtgtacaatatcatacacacatatatacaaaataatacacatatatattgtgtttgtgtgtacacacacacacacacacacacacacgtgacaacttcatgctagggagaatggtgattctagacatcctgaactccagaatgatggtgaaataggtaatgcaagtcacctccccacctgctcctgactcggtcggctccctcggtgggtgagagggttgttggtctgccctttggcgccctctaggtgagaacactgcataggccattctggtctcattgctgcagtttgtacttttcataggaaaaaattagcaagctgacctctgttttggaatgcctcagaagctagaatagaagcccactcactctcctacagcacccctttatccccacacacctgtctttgctaggtaataagcagatgcggcttgcagacacaaagcgtgaatacgattagtaaattcaccttgtgaaatgcagctccaccttcctctaatttggccttaggggttgttttgctatttttatgagtctgtatgtaattagccacaattaaaatctgaagtctctaagtattttcacagtccaatttcatctgaggcaatgaaaaataaataactcacagtgactttattacttctgtttctcagatttggggaagcagaatagtgaagtgggtctcttcacacatccacaggacaggtaggattcgcaggggcttgaaagtcccataactcaagtgcatttcacctgtactgtcaacactgtctatgggcaagacttaaggcagcaacgtccagcaattctttgtgtgcgaggatctcatttcatccttcttccagggaggagaggggtgagaaaaaatgactcccaaacctcttgttaccatcctgtctccacttctgagctctgtcattgtttatgtcatttgtattccagattccaaaaggatatgaaagatctgcctgagatctagtagcatatttccagctggctcttgggaatcaagaatatatacaaagcattgttgacaacaaatgtttatttactctgaagatggtttccccttctgtgtgagtcagggttctgcagagaaacagaaccaatgggatatacatagtgctgtggtttgaatgtgtcccctccaaatttcatgttgaaacttaatccgtattgaggtgatattaaaaagtggagccttttgggaagtgattaagccatgatggctccaccatcatgaatagatgagtgccttataaaagggctggaaagaaatggattaggcccttttgcccttcagccttctgtcacataaggataccatcaaaaaacaccactgatggagcattccctcactagatatggaaccagccagccttgatcttggactttccggactccagacctgtgggaaataaacattctggtctttataaactacctcgtcttaggtgttttgttagagcagcacaaacagacaggacagaaatacatgtaggaggagactggcttatttgattacagagagcaaggagtcccaccatctgctatctgcaagctggagaaccaggaaagctgagggttcaatttagtctgagtctgaaggcttggcaaccaagggagctgctggtctaagtcccggagtccaaaggcccagaaccagtagctctgatgtctgggggccgaggaagatgaatggaccagttcaaaaagagagagacagagaagtcctcctccctccacttttttggtctattcagaccctcaatcaattagatgatgcctgtccacactggtgatggtggatcttctgattcaaatgtgaatctctttaaccatcatagcttctaagttcccacctttcttccatccttgccccatcccttcttctctaacctcaccttgtcctcccttacctctatcctttcctctctctcctgcatacattttgtggaaagcctatgtattaagggtagacacaaggcaaaattgtttctctgttcatggaacttagatactactgcaccagctactggagaaagtattatgcacttgccaagtaatacacaggatttttgtcacttataaacacaacaaagctcaaaatctaccatcatcatattctccttcttgtcactcaaagtcacatcaagaggatgaattgattttgtcctcaggacaccttgtcatgtctcccaactttcctatataactgatggttgttactccagacttttattagattatcttcagtgttgtgggttgaaatgcatcttccaaaagatatgttcaagtcctaaccctgggaatgggaccttatttggaaatagggtctttgtagatatcatcaagtaatgaggtcttactggagtagggtgagccctaatgcaatgactggtatatttataagaagaggaagatttagacacagacacacagggggagaaggccatgtgatgattgaagcagagttggagtgtctacaagtcaagcaatgccagcaatcaccagaagctaggcgggaggcacccaacagactctccctcacaccccccagaaggaaccaaccctgcaaatgctttcatatagaaggcctctccagaactgtgaaggactttctcctgtttcaagccacccagttagtggtgatttgttaaggcagccctaggaaactggtacacccagtcagtgcaataactttcaaatagttctgcttgcctccaacactcacactccatgtgttcccatccttgattactgtggcattctgcacatggcactcaaagctgggtcaatgtgagccaagagaactcaggaaaggagagacataagagagaagaagaccctggagagagaggttttgagactggaaagtaatcatataagccattggatacttgcagaaatcttggggtggtcgctgaacttcccccagagcatgggatgggggaattcaaaggacagagaggcttctgttgccttctgcatgatgtataagaaatctcattgaatcctctctgccactgcatgggctggaactactacctgcacatacagttaggaagctgaggctctgtggggttatctcttgcttaagaatgaccgactggactgacaaagttcagccatagaattagagcccaagatatcctgctctataatgagtattcttccttaccacccttatatctctaaatcaacaaactgggttatttgtttctcttggccctgacttgctatttacctatctggatttccttctctttccctctgcacctggtcaaaagctgctcatccttcaaagtccagtttaaatttaattgtctctatataaatgttcctgagcaccttagcctgaagagacatgaatcagtcccactgaacaagactaactgacatgcatataatttaatttgcacaattgaacacctgctgtgttgtttcttcaattatgggcttggtctctttgcatcttttgttctgagttatttttttcacactgttgtaagctccttgggcagagtccataatttatacatctttgtatacctagtgggtctcagaacagttccttgcacacacaaaaaatgaggcaaaatgaagtcagatgtcttggttctcaatacagtcatctgttctggagttgttaagtgtaggatatcgaatgcttttcttaaacttcctggtctctgtctcctcttctttgacagtaggggtttgaaccagcgaatgtcagtttccttcagctctgttggactggggcactgctcctttagcttagggacacatgccgggaagagggaatgtgggactcctctggcccaatttccaggcacctggggccccagcaagcttaccttgtcagattcatcagatggttggactgtaggcatgaccttggtgttccttgcaggaaacaaaggccaggtgtgatgctggcagtgtgtctgtgtgtctcaggagtctctctgatgttccgtctgaactacatgtcgggagatgccagatctcaatccgacagatcaagccacatgtgcccagaaaggcttttggcgacatcacattcacttaggagctgtggtccatagggggctggggtatgatattctgaatggtgacggaaataagtgttcttattcttgtttacagtgcctttttgggaaaatgggtgaaataaggttctgtgtgagtgtgcatgtgcgtgtgtgtgtgttgaagtagggctggaatggaaacatggggggaaggatatttgaagctctgtagtaccgttccttattgaagtaacacccctcgcctaagtataaacttgtggatggcttccccagtgcaagtttataagtttgtaaaccccaggctctgcagattagatgtatgggcaactgaatttttttacacaagcagagaaattttaagaaatttaaagcataatcatgtacacccaaatgctggtggtttgtgctggcttaagaagcaagaatattcctttggttggtgtagcatttctctttactgaacagcattaaaatagcaacaaccgactatacacttcagagagaaccatctagacatggagagaaaagaatcaatcttgtttgtaggtagcaatgtctggtagtatccataaaatataacagccaaggaaatttcaagggagtggagcaatggagattttgtgcttaaagagggatcaattaattggcaatcatgtacaactctaggtataattatatagaaaacaggcaacatgagatcatttatttatttttatgagggaataattttattttatgctcattttactgaggctaatttcttcttattctaagaagtaaatgtgaacatgcctattgtgcatttgcaaaggaaattcaaacattgtctttgtttcagaagcaaatgctgtaaatgttgctatttcagaatgacttttatcatagttatagatgttctcatttatttgcaaatacatttaaagtgacaaaaaaggaatacttggggatttaaatagcatgttttcaactttaactgcatactgtatttagaatttaaaggggatctctgatctttgttttctcatacgttccacttgaggccacattattctagggcagtggtcctaatccacagattttagtctcttttccccacccctccagggcacatctggcagtgtctgggggcattttgattatcacaatagggagggtcccctagtacaggattctagtaggtaaaggccagagctgctgctagacagcctaaaacacacaggacggttcccatctacaaagaataatccagtccaaaatgtcaggagtactgaaatggagaaaccctgctcaaaaaaaaaaaaagaaagaaattttatttccttcttacaataatccatagttaatctctgagccccattttgtccacaacagcatggtgtcgtgacctaaaggtatatctcaaaagaatctctcattcttatcagtgcagaatagagaaattgtgtgcagcctacgtgtgatttgtcactttagtactctgtggtaggttatttgacatttcatgcttcatagtctgaaatgccctctcttagtatacccatctgacattttcgagagactaatgtttgcctaagaatgcttaaacgatggccagattttactctgagtgatactaccccctggaagtggggggaaaaaaagaaggagggaaaaaagttaagttttcattctaaacatcttcaaagcttgattggctttaataaggtatcattaattaattcaacagctaagaagggactgcaagtgttaaaaatcacggctgtcaaatgttatggcatctgggagccctagtggttggttacttaacatgatattttaggacaattctactctgcttaagcataataaaccggaaagacatgaacaaatgtcccaactgcttccctttctactcccaccccctgctctggaaagaagccctaacacctctaataccacaccactctaaaataaacccaaatgttgcacttattttactgctatgcattgagcattattatttggagatgctctatgctgcttcattaaagatctttcatatggggtggggaaactgagccacaggggatgattaaaagaaggaagaagtcagatgacttcggattctgttggctcctgactagagaacaccttaggaaaagcaatccttcatctgcagcacacagaagaaaccacattccgaacttctcggtgatgagccccgtttcctaacagtgtgaggttaatgaacctccttatttttggcagggtgaggaagtggcaagcagaaaaacctatcaaagggagcccagttccaaggctttaattgcttaggtgactattaagaaaagagcccccttctttcacagcagaaggatacagttctctgttcccaaatctggcagctattcctcaattatagaaagaagaaggaaattaaaatgtgatggattaaataagagggtgaaccggtacttatttcctaactagaaattaccatttttgtgcttttaaattgataattatcagcaccatactttattcacttttgtcataaggtccttccttttaattaaaattgagatgcttcacatttcttgcgttcccttaagaaaatctttcaagtgtttaagtccctgatattggaaagctttaattacagcatagaaaaagaagagtggaaagagctggggcggggggatgtgtcccttcatttcccgtgaacatgatcacactgggaactcagggaggtccagtgcatttgtcaacttgccaaacattatgttcattaaaggccagaaagtatccctggggggtggatacacttgagctcatttccaatcattttacctgctctgcctcatttcagagcccagtcagatcattaccagacttcccacattgtcctaaaaaaatgcattaaaattaagtcacaacagacatccaggtttgcacctgtatctcacacctgtgaggatcgcttttatattgaaataagacaaggttctccagagaaacagaatatatatatatatatatatgtatgtattaccacacacgcatatatatatgtatgtatacatatatgtatatatacacgttttaaattttattaaaaattttaaatatatttattttaagaaattgtcttgtgtgattgtaggggccggcaagttcaaaatctgtaagtcaggtcagcaggctgaaaacttaggcagaagttaatgctactgtcttgaggcagaatttgttttttttgtttgtttgttttgttttttttttcaggaaacctcagtttttgctctgaaggccttcagctgactgaatgagggccatgcacatgatccagttatcaaggagaatctctttacttaaagtcagctgagtaaattgtctaaaaaatacctccacagcacctagatgagtttgatgacataactgtgtattgtatagcctagccaagttaatacataaaactcatcatcacaggcatcaagctcaaatgttagggtttgcagtggactaatgcatacttaagtacctagatgacacccagaagggacaaaagccctgagcttccccactcagcatgctgccacctccatacccatgttgactctctttctgttttcaggttgtaacccacgtattctggttctgacctgctctattttctctttatcctcctggagcaggagtgaagtagcaagtatgttgagtcataagacagatttcactattccttgaatgctgacagaactcagagtcttatgtctcatgattttccacttgatttccatttctatgctttgggtaatgaggtttaacttgcctctccattgggaatacagattcctggaaggtagagaatcttattttctgtgtatagagttcatagttaggtttcaggtgatattcagaaaatacattcagaattttagagatgtatggagttgtgaaactagcaaaatattaatcattcttttgacacagagcctcactttgtcacccaggctggagtgcagtagcatgatctccactcactgcaccctccgcctcccaggttcaagtgattctcctgcctcagcctcctgagtagctgggattatgggtgcctgccaccacgcttgaccaatttttgtatttgtagtagagatggggtttgccatgttggccaggctggtcttgaactcctgacctcaagtgatccactcaccttggcctccaaaagtgccgggattacaggcctgagccacaacactctgcctaatcattcattttaagtgattaaatcatccattcatctacttttagtacatcctacatcctttttccttccttccttccttccttccttcttttcatccatccgtccatccatcgattattaattcaataaatatttactgttttccttcttttgagaggtgtatgacctaaactaagaggtatggagtttaaatgacttgtggaaaattagaatgttttattctctcgtttcccacaagtcatttatatagttgctaaaatttagtaactgcaataaaaatacatgattccggacaacatattctcattttacttacttctaatattgatatcagattggttctcctgcctctgagtctcagttgagatcagaaagcggtgataacagctcattgggaattggccatttgcaaccaaagtttgtgatatagttgggacaactaactgaataactgggtcacaataggagacatcttaaattactaaagctacatgattttggaaagtctggtttcatttatttaactaaactaccagtaataccttatgtttccaactttggtttttgtcagttgagatctggcttaatatccctcatggaaaagatggacaatttaggcaaaaagtatttataaagataaagtttaggcagggcacagtggctcacgcctgtaatcccagcactttgggaggctgagtcaggcagttcacgaggtcaggagttcaagaccaatctggccaacatagtgaaaccccacctctactaaaaatacaaaaaattagctgggtgtggtggtgtgcacctgtaatcccagctactcgggaggctgaagcaggagaatcacgtgaacccaagaggcggagttacagtgagctgagatagcaccattgtactccagcccgggcaacagtgtgagactctgtctcaaaaaataaataaataaacaaacaaacaaagtttaaagaagaagtgtatatttatgtattatttaattaacacatgcaccaaccgtacaactgccttcagaaagtacctttctgacaaaattagaataaaggagacatagtgggtagggaggagaggggttaggtgggtaaatttaggctatgccaaataaaaatggggcccctaggagtggggtgcctaggactagcattggcagaaaccactggagcctcgagccagcatccttttgctgaggcctctgcatagttgatagagcagtcccaaagatgtaaatggagcaattagatatcattcaatttatagtgctcttggcaagaaaaagatctttcagaattcttcatctgccctaggcaaacctttagaggctctcctcttgcttattcacacttgtggcaattttccaagaagaaattccactaaaaagagtctattttttaatccaaattgagaaaatggggaagtagtctaggatgatggtaggagttgaaattctggtgtcagactgccagagtgcaaaaacctggcccaggcctccctcctatctactaagcaggaagggggaggatgtgaagaggtggtggttgggggttggtttaccttggctaagctgctcctctaagcttccacattcccacttgtaaaatagagtaataacagtccttacttggcaaagtggttagaaggactagatgagccacttctgaagaagtgctcagtgcatagtaagcaagagaaatgataactgttgttcacatgtgtacagtgaatgggactattacatgaccatcacatcaatgataattacatttccattatttttccttttaactcataatacctttgggtatttagctggaatgcagcatattttactaaatggatacagtagaatgctccatttaataatgatatctactttgttttcttgtcctcaaatcaaagggacccgagtgcagtggtccagctattcaggaggctgaggtaggaggatagtttgagcccaggaatttgaggttagcctgggcaatatagcaagaccctatctctaaaaaaaatcaaatggagaaaactattggtccatattctatgttatagacaagatacaaaagacaaactcagattaatgcaagttaaccaactctataaaaattcatagaattttattattatttaaactgccttttctaccactgctatatttgttgactctgcctaggcatgctttaaaaattccataaacagctcacgcctgtaatcccagcattttgggaggccgaggtgggcggatcacgaggtcaggagatcgagaccacggtgaaactgcgtctctactaaaaatacaaaaataagccaggcgtggtggcaggcacctgtagtttcagctactcaggaggctgaggcaggagaatggtgtgaatccaggaggcggagcttgcagtgagccgagatcgcgccactgcactccagcttgggcgacagagtgagactccgtctcaaaaaaaaaaaaaaaaattccataaacatgtaaaagtatattcattactagatatccatcaacattgggagagaatctaaagcaacttatcccccattcttttacccagctgtattttctgctaagccacctatctcaatctgagattatattacacatttaaaattttctggtttatcatcccttcctaaaatgcatacctgaggagggtggggactcatttggtcttgcttaccagtgagcctctggtggactgataacactccataaatacatgtagaatgaatgtcaagtaaataaattcagaaaatgggcatttatgtttctaagttgaatatgtattcacaatttcagttaatacccacttgcttttattatttatcttgtgagatatgacatttccaatgcaagccttgccctactgaaaccatcatttgctgaatgtgtaattttcatcaaactgtactttaatattaatcaaaatgaaaagaatcctcttctaaatatttgttgaccttgagcttatatcatgtttgcataatgagatttaagtagaacatactttaaggtgcaaagagatattttttcatattctgtgttacaaacaagacacaatagataaactcagattaatccaagaaacaaaaataaaaaaatgaaagatcaagaaaaagctgttttttttaaaagattaacaaaatgcacaagcccttggtgtgattatcccagaaaaaaaataggacataaagaaataatattaagaatgaaaaaagttatctaatacaggattagtaaagatttttaatatcacaagagaacataattttgataaatttaaatcttagtttagacaattttctagcaattataattttacaaaactaactcaagaagaaataaaaatgtgaataaactactaattgtcaaaatattatatacaaactcgttctaagcctagaaaaaaaactgggagaagtcctcaacttattctatatggttaatataacctagataccaaagtttaaatctctttttttgaattatatgaattttatgaaaaattctaaataaagcattcataaattgaatattttaaaaccccagatacatcatgactcagggatgaggcttgacttgacacagaagaatctactaatgcaattcactacattaatagagaaatgtagagacaccatatgatcacctcaaaaagtgccaaaaaggcaataaaattcaatagttatggcttgtaaaaaccggaagtaaactaaaaacagatggagactttttcatctgataaaggatatccaccaaaaacaaaaataaaaacaaacataaaacaagtaaacacctacaaatctactgtgaatttctccctctgtggctacagatgagtaagtgcagggtctttggcagctaatagatctggaggagcccttgtccttttataggacttagaactttaagtacaaaagttccaaataagtttgacggaacaaataggcaccagcttgggcaaaaaaaaaaaaaaaacaaagctgagccttcatcacaaccatcttggattactgagcaggaatcctatacaagataatttttttaaaaagataaaacaacaactcatataatgtttaaataaacacatattaaagatttagcccattcgttaatgagggaaccaagatcttacagtcaattcaaagaagaattcaaaacacataggcacacacatacgaaataagaaatgctgaaataaatttataaataaatgcaaaattagtcaatatttccagggcaattgtgaactacatctccactgggtacaatttgtttgagtttttatcggcaggaaccagttggatgacagtttttgtggaggtgtgaagtagctcaaagacaacaaaaggcagagcccatgcagaaggtaccaccccaccatccgcttgcccattttaacatctttcacaatttctgttaacagtttaaattatattttgatgttgatctcttttaaatacttgattagggaataattttctttattctctgatgttgctgacgcttggcttaataaagagtttttattttcttatttctctttaaaacgtgaaatcagtggagccatatgccagtgtcagttagatatgtctatggaaagtcagaccacactcctgttgggccccagctggcttacctcaattgctagcaaaatgcttgcaaggaaaatgtggagacagcctaagctacagaaaccatcttgctttttttctgataacataagttttcaaagcaatatttaaacaaaagacaacatgttttttccccaagtaaatatctacagccttcctcccagcctgtcttactcccaaatcatgtccttgttatttgcaggtatccaaatgtctgcatgtgggagcattccttgtggattagggtgttagtgtctaggagtctcctcttttatgaaatgcaaacattctttgagcacaattgcaacatcagctgtgatatttacctaaatgtttcccaaggataagtggcttacgtcagagccctgaggctacaggatgtagggtttgaccagcaagagatttgagggcaggtaggtatcccatgagaaaaaaagtatcagagacacaacagcattatcccaggacatgaggtcctggaggttagaggcagcccacaagaaagcagtgatcccaaaaagagacaggaaggtgctaacgacaaaactcatctttgtgtctactcccaggctgatccgtgattaccaaaatgatccagtccacaatttccaatgctgaagacagaggaaagatttggggctgagagtgatctatgttgtttgtttatatacaagacattaggtaccctgggccattgacctcatagagaacaggcagcatttgttgtctgccaactctggattctgcaggcatcaaaggattagactctcataatgaaatcagccctttaagctactcggaagacttacgatagggatcactacccagattaatttgctaccaaatagagaatgagaggccaagataaacaaaagagagcagccagctggtagggtttgaaaaaaaaaatgcaagccattcattttccttttgttcttgtatttccaattgaattatgatggctcatcttttctaacctgatatgagctgaattttttatgatttaaatttgctcattatatttctattgcagagtggttctctgaagaacgagcctgttgctggctgtcagggtgtcatgatggtattgcgcaaatcctcgaggcagctttccagggctgctgtcagcctgctcatgccctttagccactgggcagtaaatgaggatctctaggactgaatacataatttgagggggttctgtgcaaaatgaaaatgcaaggtaccttgtaaaaaataagactttcatcagagcaacagggagcttctgggtccaggcctcaggccacacacccatgaagttgaccctgggggtctcagtgatgggataagcaaatcctttcccacagcaattacataaactgtcttgccagggactgaaggcttacaacttgggagtcagatacactttgtagctcagaaagctgactttaataaaagtagtgtacctagaagacagctgtttatttgtagaggtggcttgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattgtaagttccctgaggcctccccagccatgcttcttatacagcctgtggaactgtgaatcaactaaacctcttttctttataaattacctagtccctgttagttctttatagcaatgcgagaatggactaatacatggctttaccttagatttcttggaatctgtaagttgatccaaattgcttgatgaatgtattctctagggatccatgtgaatctctctttgagaagatttttctcttgtggcttcacttagagtctatctacctttacataggtgcatttatattgaggtgattgattatttgggtaacagctccatgtatactatgatagttataggggccccatttgtattagggtttgtaattctgtcagcatgaagcaatcatttcaacggacaatatttaatttttaatgtaggatttatctaaccaggttctgcagaggtgttcttggggtgctccagtgctcaagttaggaaaacgctgctttaggtctaagtcaggttcgaatcaaaggttttgaggtcttagtgattaataagttctgtgccccttctaatgacggtatgtaagtccaaatgccatatgcaaatcaaatctttgaaggaattgatagaaaatggcaatcttcattcagataagatttagcctagtggttaaaaaaaaattccaaataaccaaatattgaggaataataatgtagcaacaacaacagttttgagtactcacagcatgacagatacttttggtgtatttttccagtcctgtgagataggtccttgttgatcctccattttgcagatgagaaaaatgaagcaagaaggattcagtaactcacccacgtctccaggcagcaggaggcagaagtcaaatttaattccccagaatctgactctaaagcaagtgctttaccctctcaatttcatttctctacacacttgtgctggaaaatgcatgaaagtttgcatgatttcacactttcacatgagcatgaagatcagaatttatggggatatgattgttttaaattgtaggttttattattattcaggcatagtgagttcagcagatcaggagatgactgccattgaaaggatggtttattactcacagttcccaagagcaggaggcagccacaccatacagggccttttggggaagtgccaggattggtcaggaagcagaggggctgggaggaaaacatggacaagagcatttattacagtttctgtgagaaggaacaggtgaggcaggatagacagacttaggattgtctggtttaataattccaaagggctctgggctgcaggggctgtctctcattgcctggtacctggccatgggatgatttgggcaggtgaatggtgggggaggcttgtgagaatctgataaagaaggtctttggggcatgggctctgggttagttggtttgcatctggaagacacccttgtaggcaaataatttactatctttagaaattggctatccctgggaggggcagtctctccagggtcagcaaggccccagatgtcaaagcttcagaattagaagatatgcttaatgcattgacctggaagacctgggctgacaagagggacagggactgctgcctggtctaaagagtcacctcttaggaccagtgtcctcccctttgttaaaagaagacaaagagtccttgaagagtgatcataaaaagatgatgccaaagtgtcttggggagacagccacatttttcagagctgtagccacatgtctcaaagatgtagacttgtgggtaaatggtacttgaagcagaaagcaaatgtgacacttagtgattgtaagtaatcaagatgacacttcttggtaattaggcagagacgataagtaattttttaaaagtttcagatgcctattgcttttgattttctctcctctctttgttagtctcctaatgtcaataagtagaattcatgccaatgacacctaacatcagtcctttctccctggcccagcaaataaacaaaaacacagaggaggctgcctggagaactgagtgttgcctctcacctgcagcacacaggacaagctgggttcttcgggctccacattagaggtctctttcaaccagtacccagatcccagcccaccttctcttggctgagttctggagcagacttccaagtgctcttttatttctgtttggaatctgggagtcttggtggttgaagacataaggcaccaagatatctgggcttggaggggaggattctagagttctaagcaggggcactaagctctagcattgagaagtagaaatggaagagaggagagggacgagtattgtgaacaaaaagttggggtggctgggttttgtacacccagaggttctcaatgaatgagtctccatcagcccctgaggcttcctctctctcaaggggcaggagaatacctggaggaagtggggtaaagaggtcatggagattagcagtttttcaccctttgaaagtgttaggccatgtgatggagcctccagacccagaatctcatttagtccttatacaacctgaaaaagtcttccaaaaccttaggggcaaacacatcccatctctttcatttttccccccaatgaaaatgggtttatcctttaagggcactcttatttggaggtccagtactcccccctttgatgttctctcctcctcaaattgtccacaaacctagagggctgatgtggtccaaatggacccaggtttaatcaaactgtctccccaatgaaagctaagcttcagttggtgctcgctgccacatggcttgagctgagtgctggtcctttccacctgaaagatactgccgggcagctgctgacccaagctctttcccaagacattgtgtttttttaagagtggccaatgatactcacttggagctaaactcagctaataggatgccatgatctgagggcctctgcctttagagctcaaccactagaacaaaaggtctctccctaccccctccttctaagggtggactccttgctactagcagggagccagacagtcttcttagacgttcccctgaaagtaaagctgctacctgctcacccttaggcagctacacctgattccaagctctttcagtatcttgaaattgctcgattctctttctttttcgtttctcaatatattttatttttagagcagtttatgttcacagcaaaattgagaagaaagtacagaaagtttccacacacccccagtctccatacatgatggcatcaccctagtcagcagtccacaccagagtggtacatttgttacaaatgatgaatccgcactgacaacttataatcacccaaagcccatagtctaagttagggtcactctcagtgccatatattttatgtgatttgactatatgtaatgacaggtatccacagagatacctgtatgacagagtgccatgcagaacagtttcactgcactgaaaatcctctgggatcctcccattaatcactccctcccaccaacctcttttcattgtttccatagttgtgcccttttacagaatgccagaccattataacaacacagtatggagcctttttagattggcatctttctgagttttggaaattatgtaaaaacctgctctacatgtccctgagaaggttttgattggatataagttttcaactcgcttgtgaaaataccaagaagtatccttgatgaattgtatggtaggaatctgtttagttttgtaagtaacagccaaattgtcttctgaagtgctagtaatatttttcataatcaccagcaatgaatgagagttcctgctgccccacatcctcaccagcatttggtgttgtcagggttttatatcttgtctgttctaataaaagtgtagtgccatctcattgttgctttgacttgcagtttcctgatgacatatgatgttgagagttttttcatatgctcatttgccatatttatatcttttttgacagagtgtctgttcaggccttttgcccattctttaataggttgttcatttttttgttgttgttgagttgcaagtattctttgaatatcttgaataatatttctttccagatatgtactatgaaaatatttttcttccagtccatggcttgtcttctcattctcttgacaatgtctctcacagaattttgggtcttttttgtttgtttttaaatttcaatgaaggtcagcatattaccactgtattcatggtgaattagattttctcctgtcttcttctaggggttttatagttttgtgtttacatttaggtctgtgacccattatgagttaatttttgaaaggggtgtaagggctaggcctatagtcattttttttttcctgcatgtggatgtttagttgttacagcaccatttcttgaacagattatcttttctccattgtactgcctttgattctttgtaaaaaatcatcagttaactatatttgtgtagatctatatctgaggtctgtattttgttcctttgatctatttgcctattgttttgccaatacaacactctcctgatgattatggcattgtaataagtatggaaggtgaataatatcagtcctttcactctattattctttaatattgtattgattattttgagtctttttatcctcatataaactttagaagcagtttatcaaaatccacaaaataatttcctggggtttagattgggattgtgttgagtctataggtcaacttggacaaaagtagcatcttgacaatattgagtctttatagaaataaaaataaaatatttctccatttatttagctgtttgatttctttcatcagaattttgttgttttcgtcttgtacttattttgttagatttataagtatctcatttcagaaagtgctaattttaatggaaaacaatttatttttaattaaaattcatttttaattataatttaatttataggaaaacagtttaattttgttaaccttatatcctgtaccttattataatcactagtttcagaaattatttttggttattttggattttctacatagacaacactgtcatttgtgaaaaagagcagcctatttcattcttcacaagcaatatatccgcttttctcatattactgcattaagactcccagtaaaatgttgagaaggggtgctgatagagaacatccttgccttggtctcgacgttagcagggtaatttctagtttctcaccatgttggttatgatggtagctctacattttttaataatattcattatcaagttaaggaaattctcctgtattattgagctggtttttaccatgaaagggtattcgattttctcaagtgctttcctttctattgatagggtcatgctatttttcttcttcatatataggatggattgcattactttctttttatttgttcatttatttattttcttttcaacttattttaggttgaaagggcacatgtaacaggtttgttacatgggtaaattgtgtgtcatgggggctttgtgtacagataattttgtcacccaggtgatcggcctaatacctgatagatagtttttcaatcctcaccatcctcccactctcaacggtggactggataaagaaaatgtggtacatatacaccatggaatactatacagttgttacaaaatgagatcatgtcctttgcagcaacgtagatcgagttggaggtcataatgctaagtgaattaatgcaggaatagaaactaaataaatacttcatgctctcacttataagtgggagctaaacagtaagtacacagggacacaaagaagggaacgatagacactggggtctactctcttaagaaaaggcaagatgacattccagtgtccacctggctagaacagaaaaaggaaaaaaaaaaaaaaaagaacattgactcattcccagggcatcttcctacacttagattctgaaagatagtattctttccatcactcctttcctttctactcttagcacaaatatccttaaacagaattttagagccgaagtcaaagtcactttgttccacatacataccccaacatctgctacttgttctcttgatacttaaattcacttaacaggagatctggccttttttccccaagctttaattaatggttaaatcttctgaaaggctagcagaagtaatctgttagtgcaattgggtttcactcctaattcttagtgtcattctacagttctttctcaagccgtgacctgtgatcaccatgatcagggattggcaaactacagctcatgggtcaaactcagtgagctgcttgttttgtacgagctgtgagtgtccacaaaagttttattgaaacatagccatgcttcttcgttgtccctattttcaaagaccagttttgttctatgacagcagagttgagtagttgcgacagagactgtatttcctgcaaaatctaaaatatttactctctgactctttaccaaaaaaacccccaaaaaacaaaaaaaaaattgctaactcctggtctaggtagtgtgaggttcagtttctggctccagcactcactattggggaggcattaagccagtgccattctcctaggaagtgctccacatagcagctattggcacacaagtcatgtggagatggggaatcctaaggaaaagaacgatcgactttggataaacttattgaacttttaaattctgacagtatcctgcttatataatttctgcacatatggaatctgcatcctgagtttttttctatccagttcatgtttgtacaagtatcttatatgtgcagatgatgaaacagtgcctttaagcaaatgcctttaagcaatgcctttaaacaatgccttgagcaaaatgatgtatttgagtgagtttattgtcagtattaccaagcacaatgtttgactcctgctttggtaatgtcaggaagtgtggcagatggtggggagacaagaggagtcattcaggaagaagccaggagctcccaggataaaagaagcaattaaaatgcaacccttggatgggctcaaatgcagtctgcctcctcttccttatcacgggccagatccagtctttcttaattgaaggggtcaagctaaagttcttatcaacaaaagtgatgttgcttaggaaagtcatattccttagctaattttaggtgctgttttgtgcttcctgtgttaccaaccttctaaacagtaaataagagaacattgctgtctataaaaaaatcttttagttgtagtgtcaacttacaaaagaattgacaaaaaggagtggaagttcttttaagtccttgccaggctgcagagcagagctagaagaacataaagtcttaatcctttccctgctctttaccttgggggtggtggatgtttttcagggctctgtgggggactggcgtggtgtttggtcatgctgactggggagccagatgatctatctgagctctggtgttggctttgccatgtattctgaaccgtcgaatcaacccctattccaggatggttgattttatgtgtcaacttggagacattttgggatgaaattaacgtttaaattgatacactaagtaaagtgcattgctcttcataatgtggatgggcttcatctaatcagttgaaggcctgagtacaacaaaaagaccagcttccccgagcaagaggaaattcttcagcaattgccttcaagagttcatctgcaccattggctctcctggtctccagcctgctggtccacactgggacttggacttgccagcctcaataatcatatgagccaattctttataataaatttatttaaatacacacacacacgcacacacacacacacacacacacatgcgcatttgatttctctggagaatcctgacaaatttaattctatgaatagagtaaaagtctctgttaacttataataaagttcctgttcattttaaaataaaaaaaggtactattggctcctggttgagtccttgaccatcatatgcacacatgctttaaccccagacagacagcttcattcttctttcttgcacaggcaaaacggcttctcatctttggagtagtcgagagtctaggtgctggatccagactccctaggttcaaatccgagctctatcacttggtagctttgtgaccttgggtaaaccacttacttactctaggcctcaattccctcatctgtaaaatggcaaaataagaatactcaccacataggattattgtgaaaagtaatgacttaatgcaagtaaagcgcttaacaaattatctggcactcagtaaatgcttgtcccacttagaatagacctggtttgtctgcagtgatgaaacatcagtctgctgagaacttggctagaaatgcttaagtagttgagtggagccttaaaagaagcaagtaaaaaaaaaaaattctgctatgtgcctgaaggagggagaaatgaaatccttggcaaatagaatgaataatttccccagttactattattaatatgtattatgtggctagcttcaccttgttttcttgctcagggaaaataatttctttgaatattagattgatgcttctatcaaaaagcatcttctctgtcctgtttaacagagaaaacatggttcccctcctccagtagttaaagccctgagctgtgtcctccagtgcccaagcagatagcatttagtatcttgggctgttatcaaggagcttctttatagaaggaattacaccttcggtggttgggggtgggggaaatagttaaaatgcaaatgtatcagtatttactagcttttggagctcacgtctcgcgcatttcattctgaactttttgctcaatgcctctgaaatcacccttgctaatttaggcccctcggaaataattccaccaaggcagaaaattggcaaccaaagaagtttcactggcctttagatcattttctttcttaacttgtaattttccgttgctttctgttctccattaacttttcatttgtccattatattacatgtgtagtggcaaccttgattttgatacatgatgtatattcactgagcaagggggttgatccattatgtggaccccttctgggaatatgtggactgtgtctatcaatttaagaatgttatatatggaaacataatgagtattataaataagttttaaaaacctatgcacacagataatgaacttcagggacattttaaatgaattttccttgtttttagctgaatacccaataagagtctaggtatattataggtgagtgatctgtgcccttgataaccttgaaatttggaatttttgtactgaataagattcatgctaagcatttaagggcagtctgttggattcatggcaagtgttatctattggattcataagatggatcttggagaactttttataaatagataatcccatgtgctatacctgtgagattcctagagcatagagataatcgctctttcaccattgccatttataaatgtgaaaaaagtctgaaaactcagtgaggagccttaaagaatgtctaggcacccaactcttgatgcatacaagctacccagtgtaagaatgtgcatcttatgaatactgaatattcagcattggttgaaaggtgtgtgggataatcgtgtgatagtgggaggaggatggcctttattatttgtaaatatgatatttaatgcaacccaagttttaattttaagccatttctcattagtgcatcttcatatgaaatttgaatagtatgaaatcaattatgcagaggaaaagtacttgactattgataggaagaaggaatgctgtattaggagtcaggagacatagctcagtacttactcagtatgtgactttcaacaaacaattgttcccctctaagcctcagtctcctgagttgtaaaatgaaagaatgacactggatcctgtttctaggttcctttgcactttcaaaatctttaagaatcttttgttgttgttgacaaaaggatttaaagagtagggacaagtgaccatccataagtgatgaaaagaaaagttaacccaagagatacataaagtggggaagcagcagagttacagttggagaaaccagggagtgaagtcgaggtgtgccacattccctctagatgactcttgaagggttgggtttctcttctgtaaaacagagaccatagctcagaggtttgttataaggattaaatgagataatgcataaaacatgcttccaggaataaagaatcatggaagtgaataaggaagaaaggagatggaggaagaggaggaagagaaaatgacttagaaaatgtgtgattaactaagtaattaatccttctaaaactttcacattcagccaaagcacatttgtgcatacaactctcatttgtctaccttggaataatcaattttgtgagttattcacagaagatgagtgaactcagccaggttttctaatactctgctaccttcttgttcacctattttctgactaggaggcatgtaactcaagttttcatcagcctaagcccaaccacattttggagacatgtctgcatcacaaattatcttgggctttcaaaaatcaaaaataaaccactttaccaaaaatcaatcccactccatcactttggtttctctgtgccttgtgcgccattattggcatgaggagttgtgagctaaccgtgccacattttcaggagcctttgtgccatcctgtttcagcccttgacaggtgctcctgcggggttctcaagctttccttttgatttccccaggatattatcattgtggctggtcaagggaggggacatcctgagaaaatcagccaacagttcctcctggaaaatccaagctctctgattagaggggcaagaaatccaactgatatgtatttaagcacttttatagaattcccgctatgtgccaggtgcacatagttcctaggtaataggatgcagcagccaactagctgaccaagtcctcttgaagctaacattttagtggagaatgtagataacccctcaaaaaattaataaagaagaaataaaatttttgataatgggatgtattatgaagaaaaataaaagcaggggaaggggcagtgaaagtgatggggtggtctggaaaggtcgatctgaggaggtgatttttgagatctgaatgcagtgggagaacaagccatggggaggaatagagaaaaagcaatggaggcacagaaaatattaaatacacagtgggtggaaacaaacaattaacttggccagtgcagctggaacagggtaatggttgaaggacggagcccattcaggtaggcaaaggttggagtttcaagaccttgtcagctaaagtaaggggtttggatcttatcagaattgagatggtaatctattgaatggttttgagttggagaatgatgcaacttatttgcatattaaaaagattactctgactaacatattgataacagactgtcatgagaccagagtggaagctggttagtagatgactgaaactgtttaggagagagaagaccgtgcatttcactagagtagttatagcaggggtagtgtagaataatgggattcagtacatattttggagaaaaatccagcctgacttttcgctgtgtttatgtgggacgtaaagggaaagaaggagtcaaggataactgctaggtttctgtttttagcgactgggtaaatggtggtggtgttaactgaggagatgaggtgctgtatcagtgaggactcatgcaggaaaaaaggaaccactccaggtgtattaagtatgaagtggtttaataaagggaatcgagtgctttcaaaagcattggattagctgaggaaacacaagttagagaaggtgcccggtagtatttagttctgctgtcactgcttgggccagtgaattcagaagttgttgctaccactcagatgaggaaagtaaaggaaaactagtgctgccctacagcactgagaagagtaactggaatggatcacccagaagccaccgcaaaaactcttgtctgccaaagctttcgtgtcctacattgatgcatggggaagaagagtatgttctgtgctctttcatctttgaaatctctcactagtgcacctcattagcagaatatagctgcaaccagaaactgaaaggcagaagaatctgacagataaagtttccagcctttcagctggcattgcaaaagaaagcatataacacaggacagaggagagcaatagaatcttgtaggctaagggacagataataaaatatttgtattgttatgtcataaatctgtgtgtctatcggacatccaagcagaagtgtcaagtaggaagtagaatacacaagtccaggaatcatgggaaaggtcaaggatggaaatataaattggggagccattagaacataaatggtaattaaaggcatgcaagtggagagtattacctaaggagtaagtgtagatagagaaaggtcttagaactgagctccatatgcttcgggaaaaacttggacattggggaaattaggaagcacttctagggttaaaaggactgaaggccgtgcacggtggctcacacctgtaatcccagcactttgggagcctgaggcgggtggattactggagatcaggagttcaagatcagcctgaccaaaatggtgaaaccccgtctctactaaaaatacaaaattaggcagtcatggtggcatacacctataatccctgttacttgggaggctgaggcaggagaatgacttgaacccgggaggcggaggttgcagtgagccgagatcgtgccattgcactccagcctgggcaaaaagaacaaaactccatctgaaaaaaaaaaaaaaaaagacaagttgggactgggacctgaaagaagctcagacaaatggcttacatattgcagtcaagactacaagagggcttagaggtcaggaagaagaggagatgccagtcaatgcgactgacaaggtgggagagcagtctacagagtatggtcctctgaaagtcaaatgtcaaatactgatgagagttatgttttgttttgcttttgtttttgcttttgtttttgttttgagacagtctctttctgtcacctaggctggagtgcagtggttcaatcacggatcactgcagcctccacctcccagttcaagaaattctcatgtctcagcctcctgagcagctaggattacaggtatgttccaccgtgcctggcctgatgagagtttttgttttttaaattaaattaaattaaattttacgttctgggatacatgtgcaggaagtgcgggtttgttacataggtaaacgtgtgccatggtggtttgctacacctatcaacccatcacctagggattaagcccagcatgcattagctatttatcctgatgctctccctcgtttcagcccctcgctgacagaccccagtgtgtgttgttcccctccctgcatccatgtattctcattgtttagctgccacttgtaagtgagaacatatggtgtttggtttcctgttcctgtattagtttgctgaggatgatggcgtccagctccatccatgtccctgcaagggacatgatctcgttcctttatatggcttcataatattccatggtgtatatgtaccacactttctttatccagtctatcactgatgggcatttgggttgattccatgtctttgctattgtgaatagtgctgcagtgaacatacgcatgcatgtatctttataatagaataatttctattcctttgggtatatactcagtaatgggattgctgggtcaaatggtatctctggttctagttcttggaggaattgccacactgtcttccacaatggttgaactgatttacattcccaccaacagtgtaaaagcattcctgtttctccacagccttgccagcatctgttgtttcttgactttttaataatcgccattctgactggcgtgagatggtatctcattgtggttttgatttgcatgtctctaatgctcagtgatgagagttttaagaagatggagtatgagagttcaacactgtatttggccagatggaagccgtaggaaaccttaagcagagtagtcttcaaaatcttgaatgaagtggatggaggtggggatagagaatgtgcagtgagcaaataaagagagaatttacacaattctttggactcattgtgatgtaatataaagagagcagaaaaaaagagcagcagttggaaatgatgtagaatctggggagagaccttttaaagaaaggtgatatcaaggcttgtttgtggactgagaatgatgtgtgatcttggaagtcagcttgagaatggagcagtcaagacacaaattggttggcaggtcatgatcagcatgagaggaatctctatcctgcttccaggctatccttggcactgtgatttttaataaaataatgcactgactttgcattcaaagaaattactggacagtcaaaatatacacacatatgcaaaaattgaggagcaatttcccataagatgtaagcaagagtaatagttattttatgttatttctgtaagtgttagtggcagtaagtaaagaatgaattgtaaaattgtgacagggaaggtagaggagtgctttttgaaacctattttccattagatcttaaagaaagttgagaacataaatttgtggagaagtgagggtgaagattcttaagggaggcagaagcaagatttaataacaatgcagaacaaggaatcagcaaaacctgttgaaaacgtcagaaaacttaggggaagctggagcagagggttagagttgggagacctgagtgagggtcttggctttcactcagtgtgcagtcaggatccacctaatgtggaataaccatggggttctggaatgggctgagacagtgacatatttgcccatattagtggatccatgaatcattttctacaaagtcttcttgttttgtttttcagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcactgcacaaacatctttcctgtgtgctaggcatttccaaaagcagaatcattctgtatctgatttgcatcatcttatttaaaccaagacagtattggccatactgtctaccaaaacaggctgtaagaaattacaataatttttgcagctatagggtaacaatctatctcttatgggtttccagaaagtgttctgctctatatgattttaagaaaactgggacattggtgggaggatagtagttgggaaatgcttctaggattaagaggattgaagttgagactggaggtaagcttaaaggaatggctgaagtatcccatcaagacatcatagtgtcattataatgaccatgttctcttgtgaatcctcaccaatggtatagaatcctttgatttcaatttctaccactctgggaaacccctaggcttgtgctcctggtacatcagcccatttcatggtacgttgaagcatgcctccctgtgggattgctggattcccagcccagtgaggtaatgaccaagcagcgtcttcagaggaaggatagctgtacagcgtggtgaaggactcaatgagaaggtaattgatgcttcaccttttcttattttctgtaaagtaggggaatatgagtcctccactgtgtgcttttttgtttgtttgtttgcaagcaatcaaaattctttaagcttcttggaggatgggattttctagaaactgaaatttttaggggtggttggggtctaagcaatccagagaaatatgaatgcaacctcaggggaaaagatgaaaggtgctaaggaggaggcagaatagtcctataaagaaaaggcacacacatacatgcacacacacactgagactcacacgtatcttgttaaaaacattacagcaaactggagttcttaaatccccagtgcatagagctttgggagggtaattctgttaacttaaagggtagtcctctgtaatgaatgcagttcttgtgcatactcagctactgtgctctaataatgtcttactgagcttgaggatctgtcaggcaaaatatgctgatcttctgtaccctgggaactttctccaagtgaggtcacactgctgcccagctcagttctaggaccgctctggtgatgcgattttattccatgtccggcgatttagaaaacacagagttttgagtttgggttccttctaatgaatccattagtggttgtggtgggtttcattgatttcttcctgatgatttgtcttctctttaaaactggtgctatttgtggtttagtgatatgtacttgtaaggatttgggtctgatgtttggtccatcagccagatcatctgcagtttgggattcttggtaatctaagacccaatgtctgaccccttctgacctcattctgtacatgctgtttagttacagtatgagcttgttccttaaacgttccaacagccactgggctttcaacaaatgtaactgaatgaaagacaaatctttcctgtgcagatttgcctgtctaaaacacagagttaaaaacacctctcattacctccttataattatatgcttggcctcctttgaagccaaggtatggcttttcaagccagttgccctgtgacgtgagagggcagcacctttctgaagacggttctcactactgctacaccttgtgctgctgaaagcagcaggagctctgcaggtgaatgtgatttctctgtagctgcccaaggcagggccctgtatcctatggttgctcagggggactcttgggcagaagatgcctgcagatcagctttgtagtgacctccaccatcctggtctcagccatttttccttggcaccatccaggccgagcttattgcagcgaggaccaagatgtcctcatcctcaagcatgcctcatgcaaatagagtgaagccggctcatttccagcattttctttctgacattaaatgtttttctggcagtaggtttaatattactctaggcaaaaccctagggttttacacaaatcatttatcatttggacgtaattctcactatttaagcacctccagtttctacgttattgaatgagacactgtggccctcacccttccatcaggatggattgggtgaagggtcttatctaaaattcccagtgtgctctaattgtcaatcaacaattcaaattaaacaagtgacctccactacctacaggatagacttggtgcaagtctagttttagtgtgaaaagcaatttccatatagacatagaccataaaggggggctcctgtaagggtctgaacaataggtcattgtatgtgactagaaaagtggggagaaaaaaacagagaaatctccctacgggtgcagcgtttttggttttatagaaagagagaaaaacaactctttttgaatcaaatcatcaggcacaaaaaacaaatgctgccagagtaattatccctggaaaaactcagtcctgagggctctccacgccataggcttcctgatgccacctgcagctcatcccaagaaagggttggagatgcatcagcagccttcggcaaaggggaaacaccgtgcagcagggctgacttggcaaagaggcacccccagaggaatgcgaggtgcagcttctctccctttccttcttgccatgtgctgagagcccatgaccccaggatctttctgcagtccttcccctcaggttgcttagacaaggaacttaactgcacttcaactactgaacagtagaatggggtcctaattgtaaccctgtcatggattttgaaggatttaatgagacaatcaatgggaaatgcttggcacacagtatgcccccaagtcagtgaagttgcttccattcccaacctcggtcttcagtccctggtcatctcacaagcaactaaggactcaacattaattcaagggacagatctgattggaggggcctccaagatgagggaaggtcctctcggccactagggggcactaactacatggaaaacaagcactgaatttcggggacttgctccactgccctgcaatgtaaatcctgtaactcatttaattttcttggagcaaagtttgggaatggttgatacagatggtgctatttctgcttgggaaggtggttacacttacatgtcaaatgaagaaacttttcttagctcctccctgtgactcaccagctccagctattatgaactcatactttaaaatatttttttctattcagccccatttactttcagtcctctttcttctgtattctccaattcctggaaaaatagacaatatccttagttgtgtggaagaggaagaagagttatgtagaagaaagaagcatccttactgtaaaatgtttctgactttttgagccaaccacgtctggatcagatgtttccatctagagtcataccttttcatagccttttaaacctggctcatgagaggaaagagagagtgcaatgtccctgagatatctaggaaaccatggagaatttcttatcagaattaacccctattgttttgaaagtaactagatcctaggaagcatgagatgccacgggcttcccagaacccatagcaggtgagaaagaactggaatacagggtgaggtgtgatgaatcgaactgcttttcccagaacacagaatacagccaaggtatgaaagctgttccccagaggggaaaaatgtacactggccaatgagggtgcatccaagagcctgtaggctttcttgggcattgattaaaccaatatgccaggcatcacctgcttgagaattactagagatgtttgtcaaacccccagtccctggaattagactaccttgatgtacatctcagaaatatgcaactactttgaggtggttttacatttcctaaaatttaagaacaattgctctagaagataataattctacctccactgacactggaaatacatgtaaggatggctctgcatgtccttcatcacagcaagttgacattttctagaatcactgaaaggaattattgctataaaaaaatccaatccaacaataaagccccagatgatcagaattgttcatcccgaaactcttcatgtcccagaattgcacatggtgtctgggacacttgctggagtggattcctgtgatcggtgacctcccagtttgtgtgccgacagggcttagagctgcaggcaatgcagttgctacacggtatctcagtgtcaagaatcaacagttccatggagccaagagggtgcaggttggcagtggttgggtggggggatctgtttgcaagacggtgtcatggagcctttctgtggcattgaaggaacaaagatacaggggcacaaaggacatggcactttgtgctgctggcactgtttctacattgagtgacctccccaggaaatccccactgaaacacaaggtgagttttgccagatttaaacaagataattccagtgagtttatcaggaagtggaaatggagagctacattggaaatctgttttcagacatcccgtgtccatttctgtttctggaaaccacttctagatgaaccttggactcagttcatcttccctttgctctacattctctgatttccaagcaataaaaccaacagggctgtatttctctggacaagaccctcacctatcagcagaaacagaaaagcaaatcctccccgaaacagcagcttggggaagtggcccattggatgcctttttctagggctgtactgtgagaaaatgtctttcattgcatctgcccaatgctcaaagttacttctcattgagaagaaatcatagatttgacaaaattgtgagtgaacactaaagaacctgtcttctggaacgtacctgtgaggtgaaaggaaaggaacttatgtttggtgtgtggactggtgggatgcaggacaggcttcatcagggtgtgacttgtgccactgcacaggggcccatgctcagaagagctttgcacttggtttaatgccctgatggcaccatcctgaaattcttttttcttttttgttttttgagatagagtctcattctgtcgcccaggctggagtgcaatggtgcagtcttggctcactgcaacctccgcctcctgggttcaagcgattctcctgcctcagcctctggacttgctgggactacaggcctgcatcatcatgcccagctagttttagtatttttagtagagatggggttttgccatgttgctcaggctggtctcaaactcctgacctcaagtgatccgcctgccttggcctcccaaagtgctgggattacaggtatgagccactgcgcccagctggccatcctgaaattcttaatactgtgtaaacaagggtcctgaattttcattttgtcctgggctccacaaattacacagcttgtcctggtaggactgcatggtgggatttggagagctctggatttaaaattaggcagtcttggatcagatcccgctcttctacttagtaactgtcatcttagacaagtgatagcatcctccctcccagcctgagttctctcatctacaaaacagaattacaaacagaatcccacctttctggtgggattgttgttaatactgagtgagttcacctggcatatacagctagccttgaccctggcatgaagtcagtaaatgcagataatttgtactcaatttaagtaaattgtatgtcgttcttgaaatatatgtgagtgacctgcaatttaatataataaaatatgtatttcttgagttgctcttacatgtactatgcaaaagttcatatttacaatgcattatcatggctaaatcataaatatgggaaagtcagttaaataagactttaaaagaagaacccaagtctagtcacctaacacttacgaggcatttctcattgagaaaccggattatcttttatagcctctggagactcagagcctatcccaggttcctacacatccaagaacaaatgtgtcctgagcagatgaatgaaagagtaagtggacccctcaggaaaagagcgtttttaacaccctgaattaacctctcaatattcctctaacaagaaaaagtgttaggacactggggccttaacattagctttcctactcactgagtgatcttgacaagttacctaaacttttatttatgtatttatttttgagacaggatctcactcaggttgtcaacaatcgagggtcataggttcttcacccaggctggagtgcagtggcaggatcatagatcactgcagcctcgacctccctgagctcaggtgatcctcccacatcagccgcccaagtagctgggactacagggacaccccaccatgccgagctaattttcttttttttggagatgggtctttgccatattgcccacactggtctcaaactcctgggcttaagtgatccattcaccttggcctcccaaagtgatgggattataggcatgagctactgtgcctggccatcctaaacatttggacttcagattcgttatttgtgaaatggaaagtgaagtcatcataaaatctctttcaacgtattggaaggaagattaaataaacttataataggtgaacactttttgtaaactctacagtggtgtacaaatgggatgtgttaactttatatactgttgttgtcagtccagtgattcccaaaaggtgaccagggaaccctagctcctcagggataacaagcaaagccagtatccttttcagcctcagaacttaccagagcctttgatgtgctaatgagcactggaacactctgtaaaagaggagcatggtttgtggcatttcccaaatacatttgtccagaatcttctgtcagagaactccttaaaggattcacgttttagtggggcacccactggaaaacactgggctatcatgtggactgggcctacatgggtttatttggtagacatggtgccctgctcacccatcctcttcagcctctctccctcgtcatgcaggcagtgctttcctgaagagtaacaatgaggagatgggagaaagtagattatctgtttcttaactggctctttacctctcaaataaccttcctctttggggcatttttgcacagttctctctagatttaatgcattgagggcaaaataattaacccaagactgattgccatagttattattattgttctcctcctcctcgtcctcctccttttcctcctccttcctctttctcttctcctcctccaacttctccttctactcctgctcctgctccttctccttcttcttcatctctgtctttttcttctcttcttcctcccacttcttttttttaaactcaactatgtgatgatttcttcttttacaacaattttattgtcatagtttggcatagtttacaaattttcaatgaaatataaaccctaaaatttaaaatattgctctaagaatttttaaaaatagagtcatctttaagtgcaaaggggcatattattcaaattcaattttgaagtttatgtttgtacctttcctggggttaggggccattttagaacatggtaatcatggacagtatctgatggtactggtggccatttcaatagctgttagctgcaaattcaacaagtataggatacctgtctccttcttgggactttcatggcataccccttttcccaataatgctgtgtggtaaaaaataatagtaataataatgctgtgaggttcagagagactgaataactctcaaaagtcatgtaaaaaagatatatgacagagttactatttgaacaaaggttttcagactcccaggtattccctgcaaagagaaggtatgaggaacaacccctttgtctctgtgaccccacagaagcctctgggaccccactttctgattcttcctcctattcctttttgtctttgatctgcttctatttctcctctcccttttcctcttgtcttttatctgatccttgccaatcgtgctctccaaaatgaagaacctatgatccctcgattgttgacaacctgagaacatttcttgccctacccaggacagaaggaaatgacataaaaacattttattcattgggtgaaatgggattatttttgagctgctctgttcaacatcagtgaggctgctcaataaagagaagaggaaacctggcataaaagaagaaactgggcttcagctttgcatgcatatacatgtttattgcagcactattcacaatagctgcaaagacatagaataaacccagatgcccatcaatggtggattggataaagaaaatgtggtacaatacaccacggaatactgtgcagccataaaaaaagaaaattatgtcctttgcaccaacatgggtgcagctggaagccattctcctaagtgaattagtgcagaaacagaaaaccaaataccacatgttcttacttataaatgagagctaaacattgggtacccattgatataatgacaggaagagcagacactggggactccaaacatggggagggagggaggagagtaaggactgataaactaccaattgactactatgtttactccttgggtgacgggttcaattgaagccaaaaccttagcatcatatccatataacaaatgtacacatgtacccccagaactaatatttttaaaaaaataagaaacatttcctcccagagacagtgtcctaatgtggttttatcagagtcggttcttcctggtgggagataataaataatggcatcttatccagaagacttcatcaagtacctgaagtttactctgggaacatctgggctgtagcccctccttccaaggagctctgggatcaacttctgatactgagaagcgtgaagttcgaattcaactttagccttgttatgcttgtgtgtgcactttcacacttattgttaagggattcgtgagtggctgaggagaggagacacagaagactccctttctttgtaatgtgcaaaaaaccatagagaatcagtaaatgcagatgaatgggaatataaagcacttactgttcttatggttcaaaggttttagaacaggcacatccacctttactcagccacaaccaagaagactggaattcagaagcacactcgacctctaagcctgcctttctcatcatgctgtctcacacttctccctggataaataaaggcgacctgtgccctagcattgataatgatgctggggacaaagtcaagctccgacagtgttgggacagtctctggagtctgcctgggccctggcgcctgaaatggcctggctggtccttaggccgggccaccttgcctgcctgttttctggtttctttccctcctgggccatctgtttttcacctgcctgatggctgcagtctgctttccatctggtcatcgttccaaaaacatgggaagcagaatatgacaaatggtgataaatggaaagaaaggagtcacagaggtttcagcgttgatcatccacagatttaccagccattataaaatttggctcctgcttattcattttcatctgcatgccaaaagcaatcgattgtagaaaagacccgcattctttgtctattttacttgccaagtcagttggagtccagatggtgacactgacctttgcagagttcctcattcttcccaggaaatgtacattcgaggaaaagtcaagcctcttaccactttagtggtaccattaagagggtggttggggaacctggattattttaaatgcatacacgcacacacaccaagcctggaacatgctgcttgctcttatcatcaagagtgttataattttgggctggctggaaagcaaaagctccaagttagaaagcaatctgttccacccctgccccctcaccctccctgaagccagacggctgtagtgcagctttctcctcttcagacacacaccgggttggagcctgttaaattgcatcggcactgactggacctcacagaggcccatgttctatgcccctccgggaaccctcattggcttttggatactttccttgctactccgagttcgccaaatgctgtgatagacccttgtaaggtcacaagagtgcaacaatgagagaaaaaaaaagctgtgattctaaaactgaaccacactcctacattatcaggatttttccattttccagtgagagtggaatagagaagactttctgccctggagcctggttcctttccatggatcttaacaacagggggaaatagtagaccctgcacctgcaggaggaggagggtctggggaaagacaaagctgggattaacctcatgctactagttataaagaatgatttggaaggatcagtatcacccaaattagctatttgccaaacactgaatatctatcaactgataaccaccctcttattattgaaataattttgttttcataaatccagttctaattcaagaagatgccgtttcatgtgaactccatcagattacagctctccaggcacaaggggtcgctggcttagaatcaaagcacatgtccagatttcctcctcctcacttttcttcttggttgtttatagatgcgaaattctctttccttgcttctccattctgtggctttagggatttagaagaacaagagctaaatccttactttgtgtcagggtccgtaacaaaggcttcacacgtcttaacatgttgagtcctcagagcaaaggcatggagagggatatactattatcatccccattttacatatgaggacatcagggcacagataggttaacttgcccaaggtcacaggctagtatgtgtgggtttgaaccaaggccatggagctccaggatttgtgctcctaaacatgttgctgtggtcccccttagaatgtagagcaagagttctcagctgggggtgattttgcatttggcaggggccctctactttagcactgtctggagacattgttgattgtcacaggtggagaagcactcctggaatctcgtgagtggaggccaggctggagatgctgctaaacatcctctaatgtacagggcagctcccctcagcatagaactctcctccctcaagtatcaataatgctgacattgaaaaaaaccccgatgaaaagaaatcaccggacacatacacagaaatgtacacagatgtataaatagtaaatcaatcaatcaatctatctctgttgatccacctatctagctagctacctatgtcttccttctgctcccagaagacagctaaaaggtttactcttttgaaagggcctttaaagtattcactattttgaaagcttttagtagtaattttcatataagagttatagagtaaagtgatttacaagttattgttccttgaaaatatagtggtgtgtgtgtgtagtagggatggctcccactttagttcctgtggactttccctttggctgtggaaagtccaggtcattccctaagaccttgtacctgtgatttttgtctccacttggcctttgagaaaaaagctgggccaggacaggtcatctggccaaggccaagttctcagtcattttaattctaattacatccagcttacattacacattatgttaatatcacactccatcatgttacagcaatatacattatgtaatatattaatagacattacctattctgttattagcacatgacattaatacaccttatattaacacacattaaatattacatcaatacacattacatgctacattgacagcacattacaaattacattaataacacattgcaaattacactaatgcatactacatatcacagtgatgcacactacctatcacattagtaacaccttccatattacatgattaacacattacatcttatatttatacacattatatattacattcataatgcactcgatattacataacacattacatataatgtaattatatggaatatatgattaacacattacatattgcattaatgcacattacacattatattaatatgtacatcctgatgcctggttgaaggaagctcattctttctggagtccccaactctaatattcctggtcacctccagtcctagttgtcacctgcagctgatctagacaacgctggtttctcaaagagctgacagttcccccaagggcagctccctcccaggcaagcacaggccccttggctgcctgggaagttctccatgttcttcaccctagcttgcttcacggcccacagacatcccctttgtgctgtgcttacccagtggggtcctggtcctttggggtcacccccacagctgctctactacagcctacatggctgaccagggagacaggtgaagcgatgtcagtgcttgacaactcacacggcccagcgagccattcctcaatgctgatcagttcccacaagtaacaggctctggctgagtgaaggagatggtgcaggtgcaggtcaagacagggtcactgcccttctggagcttgggtctagcaggagagcggagtagaggtaagactttaattaaaagacccattgataacttggaattaagggtgatgtgctgttatatctagctgtgaggaaaaagatcatttggtttcagttcttagacctgggtgctgggcttggggaagcttgtccaactcttctttccctccaggtgagttctgtcttgaggcctctctttcatttgttccccctgctctgtggtttctaggtgcattgcccatccttcagagagctctgtgtgaatccataaaaggtgcttaaagcttttcactccatgaagcctcatctgtctcatgaaagcaataaatgtaagtggacatttgggaggaaatgtttgctttgcatgctcataactggatggctcatttggatggagattgccccagacatccatgtaagtcctccatcctagtagacagcaaactactgcagcacgaaccatattacattactaacacactacaaattatactgatacacactacatatcacaataattcacattacatattacattagtaacatcctccatattacatgattaactcattacaccttatatgagctggtttgtgctgctccctatgtaagcaccctctgtaattccatcaggatctcaaaggtctggagctcaggttcagccacagtacctgcaatgcaatgaaattaatggtattatgatagtaatgatatgataatattaatgcaggctgttgtgcagtacacctactaaggttctgggaaatagaatccacaagacatgatatacaccttatccttccttttcctccaaaacactgccacgatctatcaacaccatcatttaacagatgttgaaagaaagactctaaaaaataacttgcccaaggccagtcagtgagttggctgcaaactctctgtctttccccatttcttccttttctctattccacgtagtatttaagtcatcacctcctgttcaccccacagtgctcagctctgccacccctcactcactggagcaccagtgctcaggtcacccactatgcctaccttgcacatcccacctctggctgcacccacaggctcacgctaggcagggaagggcaggtaagggcatcaggcattgtgcccttccatagccaggctcatggagggctttctgagcagagattctaattctgccagctgacctggtagaagcccccaggctgcagccctgttctgcccacttccactcccatgcatagggacatccacaacatccacactccaggtaactgaatccacctccccactgcagcatttcagaagatgctaagtgcaggatgaaccacacacttccttctccaaactgggccacttttgagagtaaaagaggcattattaataactgagacaacaggtggatgctggacatatgtcattcaccctgtttgacaaactcctgtcgcctctcaccagcagaggaggctgtgagaccagaagacttggaaggaagtggcaggcactgattgtttctaagggagctgggttggatcctcgttttgtgtggttgggaggctggcagctggcagtcccctcaagccaagcatgatgtagtgggggtaggttatctttcttctcactgccttagtgtcctcaggattgccttggggccacttttcttgtcatcaggaagtgagcaggaccacagctgatgaccctcagcctgtcattttggtgcaatccagggtttaactggccggggagtaaaggggactgttgcaccattccaggctggctgagccttgtatctcacctccccacatctctgtatccctggggctaaatggggctgtttccatgctccttctagaagcttctccagcaccagccttcccccaaaccagaacaagagcattgatctacacccaagaggagcaggaatcagcagaaacacaatggaacaaactgatatgccatctagtggaaacacagaaagcctcaaatgaaaatctcagccaaaatgaggccactcaaccagtgtccagtgaatcaagtttctgacaaaagtcagctaaatcaaacacctctgtgtttcaccctttttgatggcaacgccttaaatgtgactgctgctcagaaagccaagtaaagaaaatataatggggctgctattggctcattccgaatcaggcattttctctcaggtcagcatttgggatcagaattttgattacataatattgtcgaaggcaacagaaaaggaccattgactcacagggtgttacagctgataaaggacttcagaattaatcaacaaacattgaggcaacattaactaaaggtcaagaactattctaaccaccttataaatatttattcacttaattctcacagcagccctatatataagcactagcattatctccacttgacagataaggaaactgaggcatgaaaaagttaagaaaggtgctcagggacacacagctgataaggcttcgcacccgtttggttaggctcggaagccactgcaccatgcccaaggtcacagagcaaggagtccaagcagtatttcccttactcagagatatgaatagccagaaacacttaggatgtttggttttacaacccacaacctcctcccccaccttcgccaaaagataaactattttctttttttctggaacttacctaacataacataatctacataaatctacaaaataatgttgttcatgagaaaggcatattcgattcaagcttatccaccttaaactgcttctgcataaccaacctagacgtatacagagtcccttctgttagttcctttgatggatttttgctttttttctcctgaaagtaaaaagcaggaacatatactgtgatttattaggttttgcatctgtgacaaggaatgcagtcctagagagggcggtaattagctaatgcttctggaatgctgcttccttcccaccagcccctggaggtcagcaggccaggggcgaaggcagctttgtcctgcccctatgggaggttgtgtttctcgacccagtgtcttgagtttgcttcggggccggcatctatggagagcagggagcatttgcactccttggggaagaggcatgaggaggggcagcggtgtcctaagctcctagtgactcagtctattcttgacctgccatcacagggatgagtttggcctgaatgaaagtcacacaccctgagcaggctctgaggtttggtttagtccacagtttttcaacctcaggactattgacgttttgtcgtggggctactggatgcactgtgaaatgttaacagcatccctgaccctccaccactagatgccagtaatggctgtaaccgtaataggttcgctgcctgatgggcagccagcaagtcagtacaccgagacagccagttgcagcagagaaagagggttcattgcagagccgctgaataagacgggaggaaacctcaaatttgtctccccgaggagttttagggttagggtttttaagggttttagagttgaccaaagtgtggagatcagtggttgatcgaagagtgcagggtgaaggcattggacaagaagatgaagacgctgtattctcatactgattcagttcctctgtgaggtgagggtcttctaactggttggtgtgagctgttccactggaattcaggatctgaaaagcatcttaagcaattttttttttttttttttgagacagagtctcactctgtcatccaggctagagtgcagtggtgcgatctcggctccctgcaagttccacctcccgggttgacgccattctcctgcttcagcctcccgagtagctgggactacaggcgcccaccaccacgcccagctaattttttgtatttttactagagacggggtttcactgtgttagccaggatggtctcgatctcctgacttcatgatcagcccgcctcggcctcccaaagtgctgggattacaggcgtgagccactgcgcctggccacatcttaagcaatttttaagcaaaagccttgtgattctaacctcagagatgctatctataagaacaacagggatacagatggtcagtgtctaggcctacctgactttctgttacaaggaagtgggccgaagtgcagcctgattaatgcttaattataactatatttctgtacagaattcttgttaagaattattgggtccaggattgacctaattttcccaaattatttaagattaattataacatggcctctcagattggttcaagggtagagtgagggggaccatgccatttgggaagagccattcagacatgtctaataagtaagcattgcttttctctaccttactcaatattctttacagatttcagaaacagcctaaaacaacattccacacattgaatgcatatactagttcacagtgaggccctagagtactggaagcaaagctgggaaaaattaaaattctaaatcttctacacagtaaatgcaaacatgaactggacattcctcatttcttccatatttccttttctaccatctttagcctattctcagcctcagatggactgacgcattaaagctccagagtgtgggtaatttatggaacttgaaaaatgcatgtctgggagccatggagagagggggaaagggcagtcccaatcagaccctcagtctcctctttgtctttcatgtactctctaatgtctactccattgagtgtactcttggtacccaactcctttaatgggagaagctttcagctgttgctcagggtattgctgctcatatgcactaaagccattgagcacactattcaggggaccctcaccagccctcttggatatttgcactattggtggtcctgaggtgacctcaaggatgagtcataggagttagtcaatctttcaaagggagtgtctgttccctctgctgggagatcgtgtgttatttgatgcaaattttcaatacaaacccactttaaatacagaagacatcccagatggaaaggaaaaaccttttcagacagctattcttcaatttggtttctggaggcataattttcttcgatggtaggcagaattctaagatgacttgtgccttgaataatcccttcctcttgagtaggggcaagagctgtggatatgatgggatctcactttgtgttataatgtatggcaaaagggacttctgcagatgcaattaaggtctcttaacagatgagttaaggtaaagggagactgccccggttgggccttatctaatcaggtgaattcttatggtcttaaagtctgagacagaagtcagagagaggcatgttcctgctggcctggaagaagaaagcagccacagtagctagaaccaaagagtggtctgagagctgaaagcagcctcagcccaggagccagcaagaaaatggggacctcagtgctacaatcagaaggaactgaattctgccagcaaccagagagctggaagagggccctaagcctcagatgaccttccagccctggctcaataacttatgttgttttaagtcactaggtctatacgtaatttgttatctggcaatagaaaatcaatgcaccttcattttattttgttgctaaattggatattcactgtattttcttatttgctttgttcttgatgctctggcatctagggccttgttgacaggaggaaaccacccttcccaaggctttactatcccaaagattgtaaaggacttgccctggagcatgcttttcatatgaaaactaaccaatccagaggccttactttgaaccaccttctctctctggctcttacactccaggaggtaatgttcctctgctctgatcatctcaggaccaggtaccagacagctagagacagcccctataccctggagcctatcaaaattacttaatctagcagatcatacacctacctagtctgtttaccctgcctcacctgttccttcccatgaaaaccacaataaagatgtctgcctctgctttccccatttccccactctgcttccttataaactttggtccttccatttgtagcccctcctcttgggaactgtgaataacaaactatcttgtcagtaacagtcatcgtctgatttgttggcctcaccatactggaataataataaaacctatttaaaacaaactgttaggatcgttttgcttatacatttcttctctatgtgttctactcagatcctcccaaacttcagaagtgtcaaaaaatactaaatgcagattattaaatcttgaccttaattaggttccattgtgaattttttaaataaaaagattgttttagtattaaaaaaattcttcacaagggataacaagcacatcttggcttttgtcccttcttacagatttttagcataagctgaaagaaaaataaaactatgggaaagattttgccagacaaaacagaacaataggcagagttccatgtaaaatgcctgattggtgcaggcagccagtatcctctaatggaaaaattcacaaatgtaacaaaaataaatggtgcatcatacattatgtttgtcaatacttttgtgatgatttatgctagaatggcaagccagagattgcctaattttatgtcctatgctttaagaccagcctcccatactttcctgaacgtctgaagagcttacaaaagggcttttgctttgttttactcaaagaaaagtgaactccttctcttactaatgatttgagcattttcctctcaggaaacaaataatatttaagcaagtgatttagcatgacactattttttgcttctaatgtaaaaggcctattacttacaaagaaaaactagatatttataaataaattattttgttaataatgtgctgttcctttacacatcttattatcttgtattaatagctctagccatactgacatttttagttttatctatacatgatattttctctaagaggcagattttagaggccagtcaagcatttggatataattttgtgcaaggattttttttaatttacaaataatggtatcacatacctgagcatctgcaaataaattggtaactgctatagttacaaataaacacacactcatgtatgcacacacaaccatgatcataaacatatccctgtgcctctcccttttctatgcacacctcatacatatagggggtatgtatgtgtatacctgtgtgtgtgtgcgtgcatgtttttaatactaaaacaatctttttatttaaaaaatttgcaatggaacctaattaaggccaagatttaataatctgcatttagtattttttgacacttctgaagtttgggaggatctgagtagaacacatagagaagaaatgtataagcaaaatgaccctaacagtttgttttaaataggttttattatgtttgtgtgtgatactcttatcaactaattgggcagtagattttgtattatggcaaacatatcactttagaatttgacatgcctgtgactgacacccacactacagcatacttacttcatcattgtaactttggatattttaacatatttggatgttcatttatttttacaacaggaagaataattcctatctcaccaagttactaagacggttaaatatggctccacctgcctgaaatcctttttctcctgaccatccacactgatgtcttcttgtcctttgaatgtcgctcactgttgtagaaagggtaaccctgactaattagctaacatagccatctaatgactgttatatctcttgattcatagcacttgtttatgtctgctttgatcatattcatttcattaaatatatatcttactccctctgtaagagaacaaatgctgtgagaacaggaccttgtttgacatgttcattattctagcatccagtgcctgaaaacatgcctgacacatagtagtcacttgatcaatatttgtatgaaggaaagaaggaaggaagaaaggaataaaaggaagaagaggggtttggtgggagggagaaagggagagaaggacaaaggagtgtgaaaaagagggatgaagggaggcaggaagaagtttaaatgtccaacacaatgactaacacattacataggcactcaatatacttcaattttctattttgtaatctgtgaattttggtaagtttcttaaactctttaggcctcgcttatcttatctgtaataatggtacatgcagtaccatccattaggattgttataaggaataaatggaaaacaaagaaataaatgcagagtatattgcactgtgcagaactatatactcattaaatattacatattaatatttttgttacttcccccaaatgatatcatcggacacaaacttctgagttcaattagaatttataacttacggatatgaatttgttcaaatagtgttatatttccttttataaaaataaccatttgagatatatgaaacttgaactcttggcctcaagtggttctcctgcctcagcctcccaaaatgctgaaattacaggcatgagccactatgcctggccatttgtgatgtaattaataagcaatcaaggaaatacttaactgtacttataattattaagttaatgtgaccaaagttaaactttaatacaaggaatgtgtgagcccttaactaaaaattataatccctctgcttgtttgatggctgaatcaaataaaccataagaaaaccactagaaaattatacttgttttcaatacatccttatacttctgaatagataaagaagccaccttaagtttttattaagaacagtttttctaaccgcaaacaagaataaaacaataaggtaaaatgccaccagaaaatgaaaacgtgagtaatgactttcttttcattgcctgatgggtatagagggttattttttcccgtacagcatagtttaattttttttcatttcttataatgaaattactgaggtactttaatgaagatttcctgcaaaatagattaaaacttacaaagtgatacaagatttgtgctttcagccagaaattgtcttttaattggccagtacaaagacaagagaagctaagggaaatggaataccatttgtgtcatttccatcacaccatttcttattctcagcacttactgagtgtgtaactgctgagagatttgccaggtgttcactcacagattgatagctccatgtataattccaaatgatagagatggagtgttgtgtcctctgatagcagaagcagcagccactgccttccccacaaacctgtcacaaagaaatcagtggggattggattttgccctgacctggataaaaggacacttcatcacagcaacagcctgctgggagaggagggaatagaccctgctcttgctgctgcagatgcctgcaaaggatctttacttggaggggtcttggagctcctttctccgcagctacaccaagtggccaggtatatgtgcacatatacagtagccacctgctttcactgttgcatgttacgcaatgaatctcaccatgggagtgaagatgcttctggttcttcaaagtgagacaggaagaggaagaagaagaagaggaggaagaggaggaagaagaggaagaagaaggaggaggaggagggaagagaagaagaaggaggacgaggaggaggaggaggcggtggcagtggcggtggaggaggaggagggggaggaggagggggaggagggggaggaggagggggtggaggaggaagaagaaggaagaagaggaaggaagaagaagaaagaagaagaaagaagaaggaagaagaagaagaaagaagaaggaagaagaagaaagaagaagaagaacactgtttggtgggagctatattccaggctccatagctggttactccaagtgaagaaaatgcggcttcaagaggttgtgaggcttacgtggcaggatgagggaagtgagggtatgggcatttatgtgatgtagcagcagcagcttgtcccagtgggaaaacctcaccctgagaggtcatgggaaatcccgagaaccacatagcacttcccatcctccatctttcctttcagtacagttccccacaatctctactaccacccccaccctctgcaccaggctcttatctacgttttttggaaagaagaccatcagttcaacaaatgagcataaaacaagactctcacagctggagcctctcccacagtttgcgctttctcctgagagactctttgatctctcctgccattgtcttggggccatcccagtggttcttcagacatgcctgaatatgtctacattccaccagcaaatgcccagactgagggtcacacacctacccacacagacacaaaaataatctcactcatcaacagtggtgcactaagtctaaggttacaaggaacagtgacacacaggaagtgtgctgtcagataagagagttatacacttcaagggacaaccaaagtggactctgatgaggacctgcatggaagggtcctggtgtctgtgcgtgaacactggagggacacttaggtctgtgaggcctcaggaaaggcttctgaaagcaagaggccctgaactgaaacagctaggtgtctaagtgttctgtggctgaaggcaagaagcaaggacaatctaggtacagggaagctgacaagggaaggctcagaggcagaaaatacttgggtgaatccagagcccccatctcgcttaatatgagaaaaacctagaatcccatgcagggagtggcaagaaaccaagctgcagtatcagcagagactgagtcataaagggcactgagggacatagcaggaagctcagattttgaactgacagaaaaaaagagtccctgatagactcaagtttctctctcagattgatagcttcatttataaacccaatgatagaaatggagtattgtctttgaataataggagctatcacgattatactgtagagcttttggaaggctaccctggaggcagtgtaacagaaggtcagaaattaagagggtcacctgatgaggctactgcaatagtccaaggggatgatggtttgggcctggactaaactatggcaagtagggatggggagtagataccaagaggagagtagcaggtagcagggccagatgacggcctaaatcgaggggtacaagagagcttgcacgaaataaacaatcagccctggcaggactgactgggactgcccttgcaggacgaagagaggaagggttaaaactacatgtcttgaggctatttgccaatgtccttaggaagcagggagtatggctaatggagcttttagtcctaattagccaaaactgggatcctgccaattttagaggctttcaaggggcatgcttcaaggaagagtccccctgagcttaagtaatgagtgatggcctgccatccagcccaggggcaatgtctctaaccctgggtcatgccagaattatactcccttgactaaacacatcagtttatccaggacccaacatatttcattttatttaatattcccccaaaccccaagtagatgtacttactactcatttcacagataaggaaacaagcttcaggagaagcaaggccatttttcacatagttggtaagcattcaaaacagtattcgaatgctggcctgtctgattcctgggttttattctatccactatgtacaatatcagaggggtccatgtgtttctcttctggacagagaaaagagtgaggagacctcaacagtggacactagcctccacaattcagaatgaagtaacctgggacttgcagaagagggaatccacattgtttcagttaggtagcatttggtgacagtgataacaatgataatgaaaacagcagcaactaatatttactgagtgcttcatatgcactagacattgctctaactcatgtaatccacccaaaaacctacagaaataggtattgtcatgatgtccagattgttgagtgaaataattttacagatgaggaaatgggcccaggagaattaaataactcttccaattgacaaggtagaggtggaaacagcatggaaattcaggcatccagcttcagagctcactctcctaaccactatattatgttctctatggtcaggttgaacacagtagtttgcctcatgttcctttatggtttgtgaatgcggctgaaaagtcccacaatcactaaaagacaaaacacagtcaagctttttattcttccttcaaaaaaaaaaagttgatgggaaagggtgatagtacacacatagggtccggcaataaatcattttttccctcccgtttcacagtgaagggcataggaatgaaatgagcttttagaattcctgagaatcataggcactccaccctaaccacagatgctggaagctgcattatgatatgtattacattcaaatgtgggaacccagggctaattttaagcaacagttcaagctggatgtaattaaaacctgcagcattctacttctggaaatgactaagaagcttgtatcgtactaatcctctcacaggtgacaattgtaaactatagccaagtttaaaacattatttgaaggcactgaagaaggaagaaatgcaggctgaatgtggaatagagtcagccttcaacaaagaaaactgcactgtatgtaaatggattttgcagggtgtttcacctgagaacacagccctgtctgcacaagatgaagtggctgagctcctgcagaaatatgcagtcttccttgtttgagaagtcagagtatggagttcataactggaaaaacttctggggtgtgaggtgggtaggaatgccaaaaaggaggatgtcaaggaggggggatcccccaaatctgtgtgcagactttgccccagttcctggctgactacacacgcataaactgcgcatgcatgtggaaaatgtcaagggtcctagaaggaggcagcagatggaggacagagggaattgagaggagatatcaactgcagtcccccacagacaggcagccaacttcaccaccctctaaggcagaactcaacactctgaccaagtctctaaaacaaaacatttacaaagcccatagtaaaataaaatattggtagacatgtgaagaaatagaaaaatgggactcaaaaaaagaaaagcagtcattagcaaccacttctaaagagaccaaaagtttggagttatgagagaaggagtgcacagcacctatgaagagtatatgcaaagatataaaggaacacggggtcatggtgagggtcaactgggaatcctggcaggagaaaataaatatatatacataaagaaataattatagaactaaaaatcaaaatgtctgagatgaaaaattcaattattttccttaagagcagattggagaaagcagaataatagacagagacaaatagaaagcaagtaagaacttgatagacatgaacctaatgatataattcattacataaatgtagatggagtaaacatttaaactaaaaggtataaatgatcagactgtacaaaaatataagactaaactatatgctgtttttcttagtgatggttctctagaaaaacagagccaataggatgtgtgggtgtggatgttgaggagagagagagagagagagagaaaaagagagagagaaaaaaaagagagagagagagacttatttaaagaaattggctcatgttaccttggaacctggcaagtctaaaatccgcatagtaggccagcaggctggagacccaggaagaattaatgttgcagctctggttcaaaagcagatggcaggtagaattccttcttccttgggtggggaacttccatctttttctcttaaggccttcaactgataagaggatgcccacccacattatagaagataaactgctttacttaacgtcccctgatttcaatgttaatctcacccaaaaactgtcttcacagcaacatccagtctagtgtttgaccaaatatctgggtgccatgaccttgcaaagtttatgttaaagcataaaattacagaacctttttatccccttatagtcttggctcatctttatgtttttgaatctcataactgcttctgtttgatcacagcttgattcactgatcttattgcatggaggcattgccttcttttattctattgagaatggaaaattgtttccaaaataatttatttctggcttttctataaatcattttgaaaagtctctgtgcttctctgagtcttcagggatactgattctttcaactttttgaatcttttgttcaaatcaggactgtattgatctttttcttttagattcattcttcacaaaagaaacatttatctagacttgacaaaagcctagagaaaaatgtgttaattgccctttcatagttgattagattactggttatattggtcaaggctcatagtggaagaaagtagaatgcactctatttgatctgaaaagaaagtgatgtatcagatggaatgatgaaccttacagaatctcagtgaggcccagggcataaggtttaattatcacataatcaaaaatacagcaatcaaaggaaatgcccaaccacctatggaactgtttctgttgctgctgcctactgctcagtacctaagtttctaggaatcagacttcagaaactgccagacctgcaacgggagaatgaacgtttctgtcacgaaccatggccactggctcccattgttcacaccctcctggtctcatgtggacatctgcttggcagaatctaagccacatgcaaaatcttctctgctaagtacggtttttagtctcctggcatctgttatactagaaggttcagtagaaggaagtgggaatggcagcggagtgagccagtgaaaaatctgctgcactaaacaatctcagtgctggatggaatacccacatctcaaatccaaggtctagaagacctttatccatggtggcttcactgtaaatgagtggacctctcatcatgtcactgattttctgggactctatactaaagaaagattttttaaaaattgcaattccttcttatatcaactccagggctcctccttcctgcatcttcctccacaaagctttattttcttaaatgaaatgtgtcaccagcaattctctccccaaaccttccacaccacaactcaccatactcactagatttttgagaatcttagtcttgagtgaaaatacaagtgtgtggggaaaaaaaggagaagtagattctgaccaccaacacagtagaagacgagccacatggtttccaggctggcacagatcctgggtacatgagctgggaacagacttgatgcagggataattttgggtaaattaattgacctgtttaaggatatttggaataagttacctataagcagaattctagaggtaatgtcctatgattttataaaatctggaagtcactcatttacatattggaaattctttttcttgacaaaaatgattcatgacttcaacaaatggtgctagaacaactggatgtctatgttcaaaagaatggtggagtaccccttcttcactccacacatcaaaaccatctcattgttcaattcccacctatgagtgagaacatgcagtgtttggttttttgtccttgtgatagtttgctgagaatgatggtttccagcttcatccatgtccctacaaaggacatgaactcatcattttttatggctgcatagtattccgtggtgtatatgtgccacattttcttaatccagtctacacctgggactgttgtggggtggggggaggggggagggatagcattaggagatatacctaatgctaaatgatgagttaatgggtgcagcacaccaacatggcacatgtatacatatgtaataaacctgcacgttgtgcacatgtaccctaaaacttaaagtataataataaaaaaatctctgaaaatatacccaagacctagatgtaaaaattaaaactataaaacttttagaagaaaacataagagtaaatatttgtgattttgagttaggcaatagctttttaagatacaacaccaaaaacacaagggaaaaacaaaacaaaacaaaacaaaacaaaatccgtgaattgaacttcaccaaaactaaatgggacaacatatttaaaaatcacatatctgataagggacttgtatccagaatgtataaatgataccacttgcaactcagcaataaaaagacaacccaattaaaagcagacaaataatttgaacagacattactacaaaaaagaaatactaatgatcaataagcacatgaaagatgttcaacatcattagtctttcaggaaatggaaaccacaagacatcactttacacccactagaatagctcaaaaagaaaaggcagacaataataaatgttgtcaaggatatggtgaaattggaactctcattcattgctaatgggagtaaaagagtgcagtcaatttggaaaacagtttgggagttcttccaaaagttaaacatagagttaccatataattcagcaattctcctccaagaatactaaaaacatgtgtccacacaaaaattcacacattaatgttcatagtagcattattcataatagcaaataagtggaaacagcccaaatatccatcaactgataaatggataaataaaatgtggtatatttattaactgaaatattatttagcaataaaaagaaatgaagtactgattcatgttgagcatcagtgaatcttgaaaacatgatgctaagtgaaaagagccagtcacaaaagaccacatatcacatgattcaatttatattaagtgtccaaaataggtaaatctatagagatagaaatcagatttatgcttgacaagggattgtggaggagggggcaatgggaagtggctaccaataggtgtggtgtttctttttggggtaatgaaaatgttataaaattagataatgttggtaattgtacaactttgtgaatatactcaaaatcactgactcatacactttaaaaaggtgaatttcatggtgtgttagttatatctcaaaaaggctattagagatttactggaatttcacaaaaataattgcttatttaatgcaagtttattcatgatattcacattatttgaagtatgaaagttcattgtttgaattaattaaaaattaaaacaacatatcaaaatgtgtgggatacagatttaaagaatctaaattttcattttaagatatagaaaatacaagcaaaagaaaattaaacccccaatagaaagaagacacaataaacataaaagtaaaaataaatgaaataaaaactaaaatataatgataatgatgatgataataataataatggtaataatagtaacatgaatgaatcctgcagctgtttttttttaaatgaataaaattgataaaactctcactagacttatgcagaaaaaaagaaagaagacacaaattaccacattaggagtaaaagaggagcatcactacagatcctatagactttaaaaggatcataggaaatattatgagctgctttattccaataacttcaacaacctaaatgaaatggataaatcctctgtcataatgttaccttgcttgtattggaatgtgtttattctcaggagacccatgcagaaatattagataaagtgcaactcactttcaaatggctcagcaaaatgtcaacagttgttgaaactaagtagtgaatataaaaatgtttattatgttattcttttattttaccttttctgtatttttgaaaatttttgtaatgcaaaattgggagaaataaatcaggtatgaatgcatgttagtagagaggctttcactccgggttagtcatttcaagtagggctgattatggaaaggacaatgtcatgaccttttcacccaaaaagcagtgttgtaaccttccttttgtgtctggatgaagcttcttggtgacactggtaggctatggaaactcccacagaacaagcacagaaaaactcacacagacatgaaaccttggcctaaggggacacttattggacactaattacccttaagagctctgttaacccaaacttcccataaaccaagcttggtatgaaataagaaaatgcataaggaagcaaaatgctgacatgaccaaatttatcagtcctgaaagtcctttcttcagaagtgatgttgcaattgtacaataataaacaatagaaggttgacaatctcatgtttgcaggcagagaacagcttccctacatttctaagaagctgtatatttggaaatggattaaattgaaggtagggataattggcattctaaagccaagtaggatgaaacaagcagaattttccatattttaatatgtctctttttaattagagtatctataaaggaaacaaattattgtatagttaccgattctttttaatgaacaaggaaaaatggtctaataatatgagcttccttttggacttgggtcctggctgatgttgggtatccaaggaccctcgctgtctttttttccatgttggacgggtaatgtgcccacattgtaacaaggtttgaggaaggcacatctcacacatgcacatgtgaacacccaagcatcacgcttatgaactacaaaaggatctaccctctccatcttaagtagagacttgagagggagtgataggcaggaagagcatcaaaacttcttcacaggacataattgaatgacttgttacttattttcttatggttcatttattcaacaaatgaaacatctcaattgttcattgctattatagatagacactaggtatactggtaaaaaaaaaaagactaaaaaatgttgtttttatttaacttgcatgatggctgatatagtaaagtcaaaattatttaaataaagaaaaggggtaatgaagactttggatgtagaaatctaggttctcatccaagctttgctgctagcttgctgagggaaccctgagtaatgagtccttaaactccctctaggcctggaggttcatccatcaagtgaggggccttaaccatgtttccaacaacagcctttccggccccatcttcctatgaaggagaaacctcagtatggcctcgtggggaacatcgtggactttggactaaagcacttttggtttgttcaattatttcatctctgatcttcatcatcttatttaactactctgagcctcaatttccttgctgcaaaatgaggtgatgtttgcttaaatgagcaagcaaagcaatcaccacagctcctggcatgccatagcacatggcttttgctcccttggggtgcttacatatgaagaaaggttttgcaatctaaagacagtaatcattttggtagtgagccagctaattgaggaggcaatttctcctccatcagactatcagctgatgtgcaacctaaaaagcatttgttgaataatgtaaaaggagtttttaccagctccttcaattttgaccatctttggactggaagatttcattcaattcaaaaaattcccaatgacatatacattgtgaacactaagattatattctttctggaagctgtgtccattccaacaagtcaggaccatttttacccaacctgtcctaggcagcaagactcctcaagagatacatgcagaggcagagttttctaagctgggctgccacatggtcaccctggggagaaaatggcagaagacagctttcttgggcccacctatcagaaggaagctcctgtggcaacagtgatctcatctcttaggggcccatggtagaaatattgaaagcaaaagctataggaatggtccaatataacaatcacagtttccttcaattttcagaaaattataaatgattaagaatacaaaatggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaagtttccttctagggtttttatggttttaggtctaacatttaagtctttaatccatcttgaattgatttttgtataagttgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccatagcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaattaaaaaaaaagaatacaaaatggattcaaaacttacagataacttgtaaaaatcaattttaaaagataacctaattttaaaatgttcagaagtcttgatcttgatcaggcatattacaatatagcatgggccactgatcaagtctccagcagccaaatccaccccctgccccagcctgtttcttataaataaatttcggtggaacacagcctagcctattcattcacacattgtccatggctgcttttgctcagcaacagcaaaactgaatagttaggacagaggccatatggcccgcaaagccaaagatatttactatcaggccccttagaaaatgatttgcttgtccctgaaatagaagctatccaagtgactgataggcatatgaaaaaacactccagcattaattgccaacagaaaaatgcaaattaaacccacagtaagataccattatccactcattagaatggcaaaaattaaaaacactgacaacatcaagtgttggcaatggtggagaacagtgggagctctcatacactgatggttgaagtggaaattggttcaattttggaaaacagtttggcagtatctactacagctaaacatttatgtctccatggctcagcaattcctggtcatattctcaagagatatgaggactgtggccaccaagagacatgtatgagaaaggtcctagcacctttatttataatagccccgaacataaaacaataaatgtctgtcaacagtatgatgaactaaataaattgtggtgtatgcgcacaatggaatagtatatggcaatgaaaaaatataagctgttgccccatgcaaggatgtttcacagacataatgttaatcagaagaaagcagatctcaaggagtccatgttgtatgattccatctatttgaagctcagtaacacatggtactagaagtcagaatagcaattacctctaggactggggattcatattgaaagagaatgaaggttgggaagcctgttggggcctgggaatgtcttagatgttgttctggcaggtggttgcaagcctgtagacatatgtaagaggttattggatggtacactgaagattgcagcacctaaccgtagaaggtacagtgttacatctcaatatagaagagaaaatattaaagaaaaaaagaccgtgggtccttttggacttgaaccttatgccacagtggtactacagagtcatgtcttaactggaactcaaattgtaatacctttaaagctttgtgttgaaaagaatgaacatttcagaatgtaattctgcatttgtgatgaagtcctcctcaataactgattcaaagctgaggagactgcagtttcccctaatgccctggccctgtctctgatgggtacatgtttgttgagacatctaccaaggggatcaatgccccaggctgatgtcactccctgtgcttgactcctgtgtctgggtggcaatcgagagccttcctgctcccccagcgagggacggacaggaggaagcaccctccaaaggctggcctgtgtcacagattgtccaggaggtgggcaacataagggatgaggtcatctcttggtgagcccatgcctggccttacagagcagtgacagatcacctgtcacccccgcaacaggcaagtggccccatgtccatgagccacagggtgccagggatgtgggattgtagctcccctgtgggtcccctcaatgaagggaattattcctccaaggagatttgggtcctctgctgctctcagacagtcagttgctttctgactcgtccacacaatggatactgcgtccaattgtatcacaccatcgtggacggctggagtcacatctaaaatgtccttgtacctccagcctccatcactgcacacctgtaactctgctcaccctaagtgcttaatgaacatggtggatgggctggtatacaaatgccttttgggggtggtttgacttacagccatctctgctctcactacagaaagaggagaggagcctcacagaggtaatgtcagtggaagaacctccaaccctcctttgaacacattcctaacaaagaaacctgcatgctttccccaccttttctcctacctgtcttgtgtcagagcagtgcctccctgctgctgatttagaaccaaccaacagctggacctgtttatatctagcaccttgcagtgttctacctagattccaaaaatgaactcaacaatgattcagtgtcattgatcaggttcataatgcttggatttgttcatacaagggctttccctagaaggttacttataaaatgaatatctaataggaggggtttaattattttgtgttgtttttcttactagccatatctccttaaaagtatagagagttgaaattagacatcatttttctttttatcaggctaactgaagtccaactttgaagttttgcaatgcttgtattttaaagtgtattggcatggccctgttagtttcctgtggctagtttactaaggagctaataaagaaacatagagattatgcttccataattataacttaatatggattttaataaaaatggattcctttatcattctctgaattttattttgtgcatttaaaatattatactgaggagtcgtatcagtttgcttgggctgctgtaacaaataccacagatggggtggcataaccaacagaaatttattttctcacagtggagactagaagtctgagataaaggtattggcagggttggtttctcctgaggcctctctccttggcttgtgagtgactgtctttttgatatgttctcacatggtcatccctctgtgtgtgtctgtgtcctaatctactcttcctataaggacagcggtcatattggattagggcctacccatatgaactcaatttaccttaatttcttctttcaaggctttgtctgcaaacatagtcacattctaaggtactggggcttaggacgtaaccccttttctttcttttttaaaattatttttatttttatttatttatttatttatttagagatggagtcccactatgtcacctaggctggagggcagtggtgcagtctctgctcactgcaacctccgcctccaaggttcaagtgattctccagcctcagcctcctgagtagatgggactacaggtatgcaccactgcatccggctaatttttttattttgaggggggggtatttttagtagagacagggtttcaccatgttggccaggctggtctcaaactcctgacctcaggagatccgtccgcctcagcctcccaaagtgctaggattacaggcgtgagccaccacgcgcagcctttttttttttttttttaactttcattttaggttcaggggtacatgtgcagatatgttatataggtaaactgtgtgtcacaggggtttggtgtacacataatgttgtcacctgggtaataagcatagtacccaataggttatctttcctgatcctcttcctcctcccaccctccacccacaagtcagccccagtgtgtgttgctcctctcctagtatccatgtgttctccttgtttagttcccccttataagtaagactaggcagcatttggttttctatttctgcattagttcacttagaattatggcctctagctccatccatgttgctgcaaaggacatgatctccttcttagttatggctgtgtagtattccatggtgtatatgtaccacattttctgtatccagtctatcactgatgtgcatttaagttgattccatgtctctgctcttgtgaatagtgctgcaatgaacatacacatgcatgtgtctttatggtagagtaatttacattcctttaggcatatacccagcaatgagattgctgggtcgaatggtaattctgttttaagttctttcaggaatcgctacactgctttccacagtggctgaactaatttacactcccaccagcagtgtataagtggttccttttttttttttttttttgcaacctcgccagaatctgttattttttgacattttaataatagccattctgactggtgtgagatggcatctaattttgatttgcattctctaatgattagtgatattgaactttttgtcatatgcttgttggccacatatgtgtcttcttttgaaaaatatctgttcatgtcctttgcccactttttaatgtggttttttttttcttgtaaatttgtttaagtttcttatagcttctggatgttagacttttgttggatgtgtgtccctgcccaaatttcatattgaaatctaatccccagtgttggaggtgggacctggtgggaggtaatcagatcatcagaatgaatttctcatgaatggtttagtatcatcttgttggtactgttctcacaatagtgagtgagttctcatgagatctggtcatttaaaagtgtatggcacctcccactcatgctcctgcttttgccatatgatatgcctactcacccttcagcttccaccataattgtaagtttcctgaggactatccaaaagccaagcagatgtcagcttcatgcttcctggacagcctgcataaacatgagctaattaaacctcttttctctgtaaattatcaagtctcaggtatttctttatagcaatgtgagaacagactaatacagatgcatagtttgcaaatattttctcccattctatgggtcatcttttttactctgttgatagtttattttgctaagaagctctagtttaattagaatccatttatcaatttttgtttttgatgttaccgcttttgggtttttttgttgaaatatttgcctggtcctatgtctagaatggtatttcttaggttatgttccagagtttttaatagttctaggttttacatttaagtatttaatctatcttgagttaatttttgtatatggtataaagaaggggtccaggttcaatcttctgcatatggctagccagttattccagcaccatttattcatggggaattttttccccattgtttgttcttggcaaatttgtcaaagatcagatggtatgtggctttatttctgggctctcttttgtgttccattggtcgatgtgtctgtttttgtaccactaccatgctgttttggttactatagcccagtagtatagtttgaagttgggtaatgagatatctccagctttattctttttgctcagtgttgccttggctatttgggctctttttttggttttgtataaattttaaaacagtttttttctaattctgtgaagaatgtcatttgtagtttgataggaatagccttgaatctgtaaattgctttgggcagtatggccattttaatgatattgagtcttcctatccatgagcatggaatgtttttccatttgtttgtgttatctttgattttttgagcagtgttttgtaattctcatagagatccttcacctccctagttagctgtattcctagatattttattctttttgtggcaattatgaaagggattgcattcctggtttggctttcagcttggattcagccccttttctacatgaatattggaggggacacaattaagctcttcatagtctttcgctttgtcccttctttgctgtgttgggatgtaacccagcaaagagtcaacaggggaaggccaccttccatctgtgtcctgtctttcatgcgtaggctcctctctgtgctctcccctccctcccaggtcacatgtaccctgacaaaagccttcccatagccttagtcatcctatgtttgatgggtacccataggagaatggtaggcggcaagaccctgaagccctgatttgggaaatgacctgcagtcttcagtgcagcacagttttaggagtgggcaccagctgtcagtgcacattccttctgttccctgagcagttccttacctctgtctttggtgtgaggcttcagactctgttggataagcagatgcccattaggggcagtgctttgaatagttcatttcaggatgttcaaattgtcagggacattttattacacacacacacaaacaactgtaagaggtggtatttttaagcacttcttaaatgccagacaccattctctaattttacatgttttactcagttaatcttcacaacactatgaggtacacaaatgaatgtgaatgaatgcaatgaaacacgcactttcagtcaaataaacccgagtgctggccattctccagattcattctttgcctgctctatgcccaggagactgactctggcctgcactgcccaggcccccttgcaggagactgcccatacaacagcagccaatgggaggacgagagcagaaagtagaggcagtttccccttttcccgtgacagagcctcactgggcccagacaatagcacttcctctctccttccttgaaacctgggggtgggaacaacttccccctattgctgtcatctgggagcctccccttcccttgtctgggcccttatccctgcccacagctcaggaaacttctgtcatcaaaggctcttcctctgcacaatttgggatgaactgtttcttagtgtattcttatcccatacattgagcaactctccttttatgtgtatataatttaggaaacttttgtgtaagtacaaaatgtgtgtgtacatatttttcttttctcccttttatttatttaaacaatgttaaaacaatctgtccctcttaattttacattttcctcaggtgctgaaataacaactaaaagttgcttgtatctgcattgtggtttctgtgtgtttgccatcaggggaaaacttctttgaataaaatttacataaatttaaacaacaaacactatcttaaacatcataacaaaggttttattttttttaatttttaatttaaattgaatttaattatttatataatttataaattttatatatatttattaatatatttatatatttttatttccataggttatttccataggtttttttttatttccatagattattgggcaacagatggtatttggttacatgagtaagttctttagtggtaatttgtgagattttggtgcgcccatcgcccgagcacccaatttgtggtcttttatccctcaccccttcccaccctttccccccaattccccaaagtccattgtgtcattcttacgccttcacatcctcacaacttagctcccacttatgagtgaaacatacgatgtttggttttccattcctgagctccttcacttagaataatagtctccaatctcatccaggtcattgtgaataccattaattattatacacaaacacacacacacatatacatatatcacagtttctttattcacccattgatttatgagcatttgggttggggttccacatttttgcaattgcgaattgtgctgctatacacatgcatgtgcaagtatctttttcatataataacttattttcctgcgggtagatacccagtgtgggattgctggatcgaatgatagttctactcttagttctttaagaaatctccacactgttttctatagtagttgtactagtttacattcccaccagcaatgtagaagtgttccctgttcaccacatccatgccaacatctattattttttgatattttgattatggtcattcttgcaggagtaaggtggtataacattgtggttttgatttgcattgccctgaccattagtaatgttgagaatttttccatatgtttgttggccatttgtacatcttcttttgagaattgtctattcatgtccttagcccactttttgatgagattgtgtttttttcttgataatttgtttgagttcatggtacattttagatattagtcctttgtcatatgtatagattatgaagatttttctcccactctgtgggttgtctgtttactctactgtctgttccttttgtgtacaaaagctctttagtttaattaagtcccagctgtttatctttgtttttattgcatttgcttttgggttctcgatcatgaaatccttgcctaagccaatgtctagatggggttttccaataccatcttccagaatttttatagtttcaggtcttagatttaagtccttgatccatcttgagctgatttttgtataagatgagagatgaggatccagtttgatccagtttcattatcctacatgcagctagccagttatcccagcaccatttgttaaataaagtgtcttttccccgctttatgtttttgtttcctttgttgaagattagttggctgtaagtatttgggtttatttctggtttctctattctgttccattgctctatgtgcctatttttataccagtatcatgctgttttggtgactatgaccttacactatgttttgaaatcaggtaatgtgatgcctccagatttattctttttgcttagtcttgctttggctatgtgggctcttttttggttccatattaattttagggtttttttttgtaattctttgaagaatgatggtggtattttgatgggaattgtgttaaatttgtagattgcttttggcagtatggtcatttttccaatattgattctactcatccatgagcattagatgtgtttccatttgtttatgtcatctatgatttttttcagcagtattttgtagtttcccttgtagaagtcttttacctccttgggtaggtatattcctaagtattttacttttttgcagctattgtaaaaggggttgagttcttgattttattctcaccttggttactgttggtgtatagaagacctactgatttctgtacattaattttgtatctggaaactttgctgaatgcttttgtcagttctaggagcattctggaggagtctttagagttttctaggtaaacaatcatatcataagcaaacagcaacagtttgacttcctccttcctctttacccatttggatgccctttatttctttctcttgtctaattgctctgtctagaacttccagtactatgttgaagaggagtgagagtgagcatccttgtcttgttccagttctcagagggaatgctttcaactttttccctttcagtattatgttaattgtgggtttgtcagagatggcttttattacattgaggtatgtcccttgtatgccaatttttctgagagttttaatcataaaaagatgttggattttgtctaatgctttttctgcatgtattaagataatcatgtgatttttgtttttgattctgtttatgtgatgttcacatttattgacttgcatatgttaaaccatccctacatgcctggtatacaacccacttgatcatggtggattttttttttttttttgatatgttgttggattcggttcactagtattttgctaaggattttagcatctatgttcatcaggaatattggtctgtagttttcttttttggttatgtcctttcctggttttggtaatagggtgatatcagcttcatagaataatttagggagggtttcctctttctctatattgtggaatagtgtcaataagattggtaccaattctttgaatgtctggtagaattctgctatgaatccatcagtcctggactttttgtttttggtaatttttaaattaccatttcaatttcactgcttgttattggtctcttcaaggtatctaattattcctgatttaagctaggaaggttgtatctttccaggaatttatccatctcctctaagttttctagtttatgtgtataaaggtgttcatagtagccttgaatgatcttttgtatttctgtggtgtcagctgtaatatctcccatttcatttctaattgggtttatttggattttctctcttcttttcttggttgatcttgctaatggtctatcaattttattttatcttttcaaaaaaccagctttttgtttcatttatcttttctattttgtgtttgtttgtttgtttcaattctatttagttctgctctggtcttggttatttcctttcctctgctgggtttgggtttggtttgttcttatttccctagttccttgagatgtgaccagattgtttgtttgtgctctttcagactttttgatgcaggcatttggggctatgaactttcctcttagcactgcctttgctgtatcccagaggctttagtaggttgtgtcactattgtcattcagttagaagactttttaaatttccaccttgatttcatttttgacccaatggtcactcaggagcagattatttaatttccatgtatttgcatggttttgaaggttccttttggagttgatttccagttttattccactgtggtctgagagagtgattgatataatttcaattatcttatatttattaaggcccattttgtggcctatcatatggtccatcttggagaagattccatgcgctgttaaatataatatatatcctgcagttgttgggtagaatattctgtaaataatcattgtttatttgctgaccttctgtcttggtgacctgtctagtgctgtcagtggaatattgaagtcccctactattattgtgttgctgtctatatcatttcttaggtctattagtaattgttttataaatttgggagctccagtgttaggtgcatatatatttagaactgtgatatttttctgttggacaaggtcttttaccattatataatatccctctttgtcttttttaactgctgttgctttaaagtttgttttgtctgacataagaatagctactcctgcttgcctttggtgcccatttgcatggaatgtctttttccacccctttaacttaagtttatgtgagtcctatgtgttaggtgtatctcttgaaggcagcagatggttggtgaattcttatccattctgcaattctgtatcttataagtggagcatttaggccatttacatttaacgttagtattgagatgtgtggtaccattccattcatcaggttgtttgtgcatgcataacttggttttctgtgtatgtgttttttttaattgtatttttgtttcataggtcctttgagatttacgctttaagaaagttctgttttgatgtgtttccaagatttgtttcaagatttagagctcctttgaacagttcttgtagtgctagcttgatagtggcaaattctctcagcatttgtttgtctgaaaaagactgtatctttccttcatttatgaagcttagtttcactagatacaaaattcctggctgataattgttttgtttgaggaggctgaagatagggccccaatcccttctagcttgtagggtttctgctgagaaatctgctgttaatgtgatcgttaatacagagtgacaacttgattgggttgaaggatgcaaagttttgatcctgggtgtgtctgtgagggtgttgccaaaggagattaacatttgagttagtgggctgggaaaggtagacccacccttaatctggatgagtaccatctaatcagctgccagtgcagctagaatataaagcagacagaaaaacataaaaagcctccactggcttagcctcccagcctccatctttctcctgtgctggatgcttcctgccctggaacatcagactccaagttcttcagctttgggactaggactggcttccttgctcctcagcttatagatggctattgtggaaccttgtgattgtgtgagttaatgttactgaataaattcccatactcatatatatctatatatctatatctatatctatctgtctatcatctatctatctagctagctagctagctatctgtctatctatctatctatctatctatctatctatctagctagctagctagctagctagctgtctatctatctatctatgtagctagctagctagctagctgtctatctatctatctatctatctatctagctagctagctagctatctatctatctatctatctagctagctatctatctagctatctacctatctatctatctatctcctattagttctgtccctctagagaaccctgactaatgcaataggttacctggtatttgtgcctcacagctcttaagattctttccttcatcttaactttagataacatgttgacaatgtgactaggtgatgatctttttgtgattaatttcttaggtgttctttcagcttcttgtatttggatgtctaggtctctagcaaggccagggaagtttttcttgattattcccccaaatatattttccaaacttttagatttatattcttcctcaggaatgccaattattcttagatttggttgttttacataatcctagacttcttggaggcgtcattcatattttcttattcttttttctttgtctttgttggattgggtaaatttgaaaactttgtgttcaagctctgaagttctttcttctgcttgattctattgctgagactttccagagcattttgcatttctataagtgtgtccattgtttcctgaaattttgattgttttttatttatgctatctatttcattgaatatttctcccttctcgtatctttttttttttccttgcattggatttttcttttgtctggtgcctccctgattagcttaataactaactaatcttttggattctttttcaggtaaatcagggatttcttcttggtttggatgcattgctggtgagctagtgtgattttttggggttgttaaaaaaccttgttctgtcatattaccagagatggctttctctggttccttctcatttgggtaggctctgtcagagggaaggtctggggctcaaggctgttgttcaggttcttttgtcccacggggtgtttccttgatgtaatactctccctattttcctagggatgtggcttcctgagggccaagctgtagtgattgttatctctcttctggatctagccacccagcaagtctaccaggctccggattggtactggggattgtctgcacagaatcctgtgatgtgaacaatctgtgggtctctcagtcatggatactagcacctgctccacagtggaggtagcagaggggtgaaatggactctgtgaaggttcttagctgtgattaatccactattttggtgctggttggcctcctgctgggaggtgacacttttcagagatcatcagctgtggtagtatggagaggaacaggcagtgggcagggccctagaactcccaggagtatatgccttttgtcttcagttaccagcatgggtagggaagaaccattaggtgggggcagggctaggcatgtctgagctcagactctccttgggcaaggcttgctgtggctgctgtgggggatgggggagtggttcccaggtcaatggagttatgttcctgggaggattatggctgcctctactgtgtcacgcaggtttttaggaaagtgggggaaagccaacagtcacaggcctcacccagctcccatgcaccccaaagggccagtctcactcccaccatgcctccccgcaacagcactgagtctgtttccaggcagcgggcgagcagggctgagaacttgccccaggctacccacctcccagctgcaaaagcaagtggggctttcgttcttcccccaccggtggagtctgcacactggtttcatgccctcccctgaatctggccaggagacttctcattccgttggaattgttacaaagttcagctggaggtttccttctccctgtggtcttttgccagtgcctctggcagccctcctcaaggacccctgtgaggcaaggcagaaatggcttgctaggggatctagtgagtccacagagcttttcctgctgcttcctctacccctgtatttcgcttggctgcctaaattgactcacctccaggtaaggtcagaatcttctcccataatctagaccttcaggctccccagtgggggtctgtgtttgggggtggacgatctccctttttcacttccacagtttgggcactcacagtatttggggtgtctcctgggtcctgcaggagcaatttgttttcttcagaggttctgtgggttctcttggctttcctaatgtattcctgcggtcattgtggagcaaaagttcacaattcaagcctccacaggctgctctgtccatccgagtgggagctgcaatctagtcctgtctcccgtccaccatgatctccccgataacaaaggttttaaaaatgataaaacagaaaacaaattattgcaaaatgtcagctcctgtaaataaatctatgaatcgagggctaaattcataaaacaaattttaaaagtttgagtggtggttttgttgaagattttttattgttgtataaaaccagtcgaaatttcttcaggtaaatattaagttacttatgcaaatttctaataacagttcatagcatacagaaaatggcctttattgcttcagatatctctgtgttaaacttcaattatggcttcagtaatagtgaatctttcctttaaattaaaacacaatatttatactatataattctagggggggtccaaagacatggaaataaaagtcataagaattgaatgaaataaaattttccttgaaaaacagaaacagaaattataatgctatatctatttgaataagagcagctaaataacagtagctaaactaaaaagagataaatcaagataactttaaagagatagcccaggctgctgtgtctcactgtgactgtgggtgttgagggccctgctgctgggagagctgagtgaaacctgctggccctgaatccctaagcctcacagcacctcacttctccttgctgggaacctgatgactcaggggacccctggtccttgtgggcctctgttggctgtacctgaagcagcaggagcaaagaacccctagtaaaaggcaggaacttgaactccatgtcagccaggatctgcctactgcaatcatcttcttttcttagctcccggagctttctctcagtggacagaactgccctccagctttcctgagctctttccacacaggcaagaatctccttctgatagaaggaagtgattctttccaattctttgctgatattttcagccatctccttgtagaggctgtgaatctgctgtgtgtattcacatttctacacacgctcagaagtttcttcttcatttctaacctgtgtgtttccaccgcaggtgatcttctctgaagttgcgctatgtgttcttgatgtgattcaggtaggatttgaagcttcagctgcaggttctggatcccacctgcaagttgggaattttcaaactgcaaagacgctttctcagtttggagatgtttgatttgtcctgtgagctcttcattcattgattttttttcccacaattgtcaagctatttcttgatttttcttgactttcacagaacacatttaagtcaccatcacccaggacgctcttcagatggccttctgactgatagttgggcgggaggggctggggcaggcagtcttcattttctgctttcctctttagctgtactttcgagtcctcgtcactgtggtccctagagaaatctcccaactgcatggtgtccagcaggttttcagccatagattttaattggctcatggtatctttcatgacctgttttatttgtgcattcaaaggtttccagcttttctttctctccttcctttcctgtactgtctgcttccatcttgcaatttcttggtcgagcacttctggactttctgctaaatgagtgttttcattcaaactgttatttccttctgaagtttttctccatccttctttgatccttttaagatgtgtcctgaatcagtcacttgagaacatttaggagactcacttttccatgctttttccagaaagccgcctgtgtcctgcagggaagacctgctcagatttgtattaatgattgacaagcagggggattgtaatatttaaggtctgtggcaacttgagggcttcctgggtctgtgtctttagcccagtgttctgcctgccttctacatggacctcctgaagagaacaccttttgttcagctcttttcctcttcataaagtgccttgtttcttaataattaagaccacacagcagtacaaaccaggatctcccagggagccctggggtttatctcatgatctcagccttcaccagctctgtagccccagcagctccagagcagctggagagacatttggggaccagcagcccctctgtggctctgcctttgcttgccagtggcctgtgggccacagctgcctactcggaaccctgcggagtgttctgtctctaatgctcacaagtgcctggcaaccaggatagaagatcagttgtgctgggggaggggagccagccaggttgtagaaacagcatccctgactttgttctgctaactgtgcagagagaggtgatagtctccgcccaggccatgagggacctggaaatggctgatgacacggtggagctcggccacaccaggcccagctggccccacagcaaaccagagggtccaagtgggtccatgccctgtcccttcctgtccacaagggcctctcaggggacagtggtggggcccatccctgggtgaggctcagtttcctgatttcaagtttccttccgcacagggaagctgggtcctgcccaccaaggtcccagggatcctcctctgaggccccctctctcctttgggtttagtcaacggagagggagatggggagaggactgaaaggtctccccaaaggtacaagctgagagacctggatttgcaatgtaagaacccaggagaaataagtggaactgacggggtctaaaatgtcacggctattctgtaaagcaggtttgtccctgttccatccaagtgtcctgagtgagcgggactctgcttcgagggtgtcaggttgaccctggctctttcccttgtgtggccctgctatctttggtacatgcctcccaaggtggccctggggacagtctccaatccactgagtcatcttcagaagtctgcatgcatctgcagaggggcaggtccttctcagcctggattccactaaacctcttccccggcagagtcaggctcagagcctcctcgtgcagccctggactctgccgggagcaattagtctcagaatctcgatctgagagagaagcgagcgaactggcagctggggccagtctggggtcctaagggtgttggggttccagaccctcacaggacatagaggggcagtggaagtggccctcccaggagaagtcagatcccttgcagggccgcaggaccccaactctgcaagggcaactggttggtcttttaaaaggatcaaaatgtgttgaagaaacgacagtaatgcctagaacaccaacctggcactaaaatgagtgaaacagagttacaaccagggacccgaggaagatccaggatattttgctgagtgaaataggaagatgcaaaagcacacatgtagagaggaatccacaaaaatctcaaaggacacgtactcactccctcctttgaaagcagaatttgaagaagcaaagaggagctgctccctgagcttctcgcatctcccttctcctcccttctcccttctcctctcccttcctctcccctctactcccctctcctggcttctcctctccacttctctcctctttcctcctctctcctctcttcttcccttctctctcttctcatctcctcccttcccttctcgcctcccctcttctctcctctcccctcctcttttctcctctcctcccttcctccctcccctccccactcctaccttcctctcctcctccctccttccctttttgcctcctttcccctcgtctccccttctctcccctcctctcccctcctttcccctcctcctccttctctccccttctctcccttcctcccctcctctcctcttccctcctcccctcttcttccctccactcctcccctcctctccccatcccctctcccccctctcctcttccctcctctcccctcctctcccctcctcccctcttcttccctcctcccctcctcccctcctctctactctcccctctcccctcctcccctcctctcttcccctctcctctcccctcccctctgccctcccctcctctctcctcctccactcctctctcctcttctttcctcccctcctctccacctccttccctctgtcctgtactctgctctctcttcttccatgttgtcttttcttatatgtactttaaatatttttgattttgttaatacaagtactgtgtatgcaattcatacctttttagcagacagctcacatggacccaagttggggttaacatgcagattgtgcaggggttccctgcggatgcacccctgtgtgccctgatgtggacctgctccttcctgcttcctgggctccagacagaaacaccgtacccctgcaccagcctctgcctcagctcttcacagtcagcacaccctccgcttcctgtcagggtgttctctgctgagtctggttatgggatccctttctgtgcagagccatgctcccgtgtcactgtgtgtcaccttcaagctgtccccgtgtgtatgcctgtgtgagaatatgtgtgtgtgggtttgccatcgaaggaaaacctttattttggctgctaacatttggaaacatttagagaacaaacaatatcttttaaaaaacatcaaaggttcaaaaaaacaagacaagaaacaaactgttgtaaaatttcaactcctctaaatttgtcttaaattgaacttagaactaatctaataaaaatagtatgaagtttcaatggtgtgttgttgttgtctagtattttttggcattgttttttaaaaaccagtcaaaatttattcagctaaatattacattatttgtacagatttataataatagcttacagaagtgaactttattgttttccatgtttctattcatgtccaattttgatgacagtttaaatcatagtggacctgttatttaaatcaaaatataatacttatgcatataattttagagggtccaatgattttgaaataatgtattcataagagctattttaaataaatgtatatttaaaaatacaattttagaaattatagtactataaaacttcagaaagagaaattgcacatcaattaaataacagtagcttaactagaagataaatgaaaattacttttaaggacgaaaacaaacaaatcataaactctgagtgaaacctgcaggtacccctggatccctgagcctcacagcacctgcctcttccttgctgggaacctgatgacccagggggcccctagtacttccactcctctgtgagctgcgcctggagcagcaggagcaaaggggctgcttgggaaaggctggaacttgaactccacatcagccatgatttgcctgttgccatcattttgttgttttagctcatggagctttatctcagtcagcagaactgctgcccagctttcttgagctcttcctcatagaagagaatctccttttggtaaaaggaagtgattctttccaattcattgttcatgtcttctgccatcttcttgtagaagttgaaaatctgctgtgtgtagttcgtatttctgcacatgatgggaaatttcttctagatttctaagcatagaggaacatagtaatttaacagggagatacagagtgaacacccttttaatcaaatgataaaatgataaaagttaacataaaaatattaggacaagctgacatcatgtacctcctgatatgatgcactgaaaagaacacaacattatttctatgattttctgccaataatgcataacctgaatctaaccatgaagaaatagctgagaaccccaagttgaagggcataccacaaggtaacagcccatattcttcaaaactataaaggtcaataaaacgtagaaaaggctgaataattattttggaattaaggagacccaggggatgggagagccaaatgcaatacatgatgctggattctaccctggaccagaagaaaactagttacagatgaaattatttggaagactcacaaaatttaaatatggacaatggattaggtaaggattgtgtcactgttaaattccagttttgatcattgcattctggtcaggaaatgtcaaaatttagtgtcagtgggtttaataacttcaacttatttcaaaacaaagagttgctaaaattcttcaaccatgatcccttcctgacattgtggtcaagctatgtatggctcatggtaggtctcttctcattttctggtggggtacttaatgtgaaaacacagcaggtaaaaccatcataaaacatcttcaagttctaacttccttgagtctacctatgtctgagagtgtcctccaggacatttcagggaatatggagaacgtattacttgtggatgtccttctccaatcaagtccttcaatccttctgttcctcctgcagtcttctttctggccagtatgatgcctgaacacactctgagtctaaagagcttctggcacctatgttctctgctggcttccgtgaaaagctctctctttaaatagccataaacctggtagcttaagacaactgaaatttattattttatagtcctctagacctaaagtcccaaatcaaggtgccggccgggccatactccctctgaagtctctaggaaaaggtttttctttgctccttccagcttctggttgctgtgagcaatcctgtcattccttggcttgtggctgcacccctccattctctgtctccatcttcccatggccttctctgtgtgcttctctgtgttctctaatctatggataccaatcatgaatttagggccaatcgcaatacagtaccctctcatcttcatccttaactaattgcatctgcaaagacctatttccaaataaggtcatattctgagattccagatgaacatgaacttttgggggccattatccaacccactacaccagtcttcactgcctcaatcaatttccatggagtttctctggattatttgaaaacccctagcttggttttatttctcctggattccaaattttccctttgaatagggctccttctctccacccacaacttagaattctcttctctctgtctcctgttcaacttcctttttctttattctgtatctcacagagacaggcggtatccttccatacccttccttggctcccaggacccacacctgttaaacatatgatgtgtctcatatgtggattctacccaagatcctacagaggaaagatttgctgggactgaggtacggtcctaaagagtaagtcaagatcctgctcacagactctccaattctcatggaggactgtggcttgtcaagtaactcagaaccactgaatttttctgttcaaccctattctagttattttggctctaagataaagaaaaattaattacttgcatatttgatcaactgaaaaaatccaggctgtatgttttgagtcctgatcaattaggaccacttgcctaaaggaaacaatttaatgatttccttcactttaaagttgtgaagaaattctggctgcctttctcattgcatctttatgaaggccagactttatgaaaaaatagtgatgatagcaataagtctggaacttggtaatcgacaaagctctgctttcgtgctaagtctcaggagagcttttcagtactctatgaagtatggattgggcagatcatcctgccagcattacagacagacgaggagacaatcatactgcttttgttcttggactggctcatagtttgggcacaggcatgattaatttgttcataccattgtaagactcttatctctaaaagcacaaagagaacacatcagaagtagatctttacatggaacaaaaccaactaaccattttgcccaaggagcgactttctcatctgttttttttctcatctgtttttttctcagtttccttctatttctatttaaaaggcaagttaaaaaaaaaaacaataagatagcatagtagtggaaaatagctcagcccttacagcaagacatcctaggctgaattccatttctgccacctactaacctgatgaacttgggtaatttccttaacctctctgagcctctgtttattcacctgtgatattgtttggctctgtgtccccacccaaatctcatcttaaattataatccccacatgtccagggagggacctggtgggacatgattggatcatggaggcagatttcccctttgctgttctcatgatagtgagtgtgttctcatgagatctgatagttttaaaagtgcggcacttccttgctctctcattctctctctctcctgctgcattgtgagatgtgccttgcttcccctttgctttctgccatgattgtaattttcctgaggcctccccagccatgtggaactgtgagtcaattaaacttcttttctttataaattacccagtctcaggtagtattttcatatcagtataagaatgcactaatacaacctgtagtgtgaacctcaaagtcaagttgagaggattgaagaaatgatgtagattatgtaccctgtgtgacgcctctcatgttattcagtggtagttggctccctctccacaccttcttgggagattctaattttgtcgaaggatcagtcctagatcgcagtggcagtgctgacattgctgtaaacttcaggccaatgtggcagcataccatctagccatattgcaatggagaggtcatgcaggggtactgtatgaatcagtgcccagagataaaggggtggtctgtcctctgctgcaaagtaggacaatgcttggtctccagctcttcacctcctggaaactcacccccgttttgtgcttgaattcatgctctctgaacaagagaaactcatgtcatctctctcatcctgtaaagcactgctgagaacaatcatgctaaaataatttagagagagaaaatgttaagcaaagactgtcaaaacaatactcaagaataccaataaggaaggctgttttcagttagcaaaatctccaactaggggagattaaacagctcttacaaaagtgcgcgttatacaactatttcatcacacgttgagagccagcatctcaggatccagccgtgaaccaacatctgaaataccttttcccgtaatccccttcatccaagaataaacacttttaatgaaagtcccaagaggaagtaaaaaagaatttgtttttccagtttcttttaacaatctttcctaaaatagggggctattcttgtttgcaccttccttataacagttcagtcaaatgtggccactgctacagcttctagcaagttccctgggtgcagagaattgggaactggcacctgcaagacaagcaggcaccaggattttgggggattttaatttactaactactctttatccttttggtgagcttgcatttcaaaccttgccaagagacacatctccttgaattctgctgtcctgtctcaatgtgaaaggcttaagaaggatcattttgttatttcaaaacactagagcaaatacttccaagactgtcttgaaaagttctttggaattaacatcaagcacttactatataatgaaagagtcatgcatatacgattgttcttttagctgaggagtgtttggtagtaataatgggaacagaatttgagagccagattctaagcaggaatgtaataacagacttgaagataaaaaaaatatggctttcccttagcaggaggagttgttgaaacctgaaaagctctgtttatggttttaccaggagcttctaacatcatgtagaaaatggatgtacaaatgtaattaaacacagtaacatgaaactgcatggaaaatttggcagggaatcatatttttttcctgattatataagtaatacacatgttctttgtggaaaatatggacataaaaatatggcatgtagaagaaaattaaaattatacaattataccacaaaatcattttctgatgtatatatattatttttctaaaaaattgtatttatgccctattcatatttgtcctgttgctttttgctttatgcttaatttaatcatatctttatattgtagtatgtgaacggctatctccctaggacacgtattgcaaacattgtttttctttaagatctagagttttatctgaaacatttatttgaatcttgcaatccactccaaaacatacccacatttgttttactatcaaatatgtagcatataaatataaaatgtaaactgcattgtagataagtaaatattatgtacatatagacataaaatataaactacaaaattataatatataaagcatatcaaaataatattaatgaaatgtatgaagctgtacataaatgaaagatgctatgtcctctttaaaattttaatttcataccatttaaacatatctgcttaccacatgcgtaagaatttctttgcccaacttgaaatagcaaccttaaaatattctatgtcactggaaaaaacttgatggcaattttttatatacaaccccacatgcacacacacccacacgcagaagaacaacatccatttagggactccttggacaaaatttcaagtcttgaagaagtaggtttactcaagcaaaactaacctcctttccaagtctggaataggtatgagatgtcctttcactagatataaatttatcaatgtacagaaaaacaaaatcgatgggtctcaatttttcactgtaaaatttccttccttaaatttcatacagtttgggcacctgttgttccttgttggcctgtaagaaaatgagtcaccatgtgcaaaagatgagccatagatctgttcagaaatagtcactcatgtttgacatgacagcttgttttccatatattctcttggttgttattttacattgcatacatataataataaagtcatattttctcccagcatggctttctaagtggagttaaatatatcaatattttatatcatacttcacagagtgtcatggcttcccattttgccacctgatccagactgacagtcaccgctgtaggggaccataccatatacttaggcatgataaaggcccataggttgaaagacagagaagcatccctgacccagtaacttaccatttactggaggaacgagcccagcctaggctgaagagctagttgaggaggtgtctccaccacccaactcaacgaagtctaacatttcacagctagatcatcattcctttggctttaacctgcagaaattgtattgcttcccaaaatgcatatataagagaggtaaagccatacaatttaatcagtcatctgcaatcgtgtttctccaaaaggggtggccaggctgtctgcatcagtatcctggggtagggaggaggagggtggatgattgattggagatttctgagtcccatcatgagagattcttattctgtagatctgtggaggcctctgggagtcttcattttagcaaacattccaggaaattcctgtgaacattagaatttgagaaccaatcatttatactctgaagtgaatgtacttacgaatccttccttgagaacagaggagttgcttactaatctctggggcgaattcagtgaccatcactaacagacagaaagaggaatctggacaaagcacaggacaaacctcactttttctggagtggtcatctattaagtgctttcttggagagggtatagtaattgtatatttcatataaatacactgtagaaagagaaaaacaaatatttagatatttgtgtccccttctgattatctacgaagggatttacatggcacaaattaaatctatccactcaccctgaagttctgtccttccttcaagcaggagccccagcagagtggcccagggccagctgtttttaagcagcctctgagagcaacacagcaggtcccacccaggagaccacagagctatggtgggggaagccacttacctcctgtatgagttccctggggttgctgtgacaaaggacactgagagagtgtctcagataatggacattcattgtcacacagttctgaggctggaagtccaagatcaaggtgctagcagggttggttccttctgacagcaatgaagaagaatctgttcctggcctcttttctggcttctggtagccttgggcattccttggcttgaaggtggtcatcttcttcctatgtcttgaaatcatcttccctccatgtgtctggctctgtgtccaaatttcctctttttgtaaggatagtggtaatattggattagatcccaccctaatggtcttatcttaaattgatcatttgcaaagactatttccaaacaagatcttattcacaggtactggagattagggcttcaacatcttttgggggtcacgattcagcccatcatgccccctcttctcaggtctgtctgaggcttgctgctctgtcccttagtggctggggacagcatgcttgcctatggccatgcctgtagctccactttgctctgagaggctgagcaatgcctctcatcagtcttcccacagccccttgagtggcccagcacctactcagtgacccatagggatccggtagaaggagcaaatcacagcaaggccataaagaatttaaagcttaacccagatgctgagctgggatgcaaagcaacaagctagaaaattgacaggcaggccccaaatggtcttgcagagtctaatgtcatcaggtttctctgtgatgtggcttttattaaacacttcttaataatttgtgttattacttctgagcttagaaatgaattatactcattctctggaaatatttttagactttgcctctaggtcatgaccaataaaaggtttaaattcaaatactgaatgatccaagggctcacttcctatagaaatatcttcatctatgagaatgataatagtgataacagcaaatatccatggggtgccataatttataaaaattatgtgtttttacaagaattatttacttgtcacctcagaggaaactcaaaaggaatatgactattagccctcagcggaagctgaaatgtatcacctatcgtaaggtatctagtctatttcccatgatgtttactttttgtgtccgagaatgttgcatactctcattcaaagtctttcccagaaaggaccagttgataaagccactggctctttccagcatcacgcctgtactgatgccacagtggacagcctttgatgccacaggaccacagctcaatctcctgattgtgaggagaagagtgggggtgttctcactgccccagggcattactaaaacaggtttgatcagcaagacattaaacaacagagattaggcttaggaatctaatatgccactatgtgcttactgttgtccaaatattaggaaacacaatcccagatcagtgggttagatttgtgttcaaggggacaagttggaatgtgatgccctcacttcaggtgagctctctttacttgaaacactcttaggtttactggaaggactcattctcgggaagtcacgctcttttttacttaacgtctttcatcatgttaaacatttattttatattctctttcagattggcttcttattaacccagattactgaggttctaattctatttattttgttcccgctgacccttaagtggagtatattgtgtcctggtatatttttatataccaggttttatatttgcttctgctaagattccaaagaggcatgtttgtctgggaaaatctgcaagctaatttcttagctagggaattcctgaacaaagaaggaagtgaaaatctgagccccaactttgtgtttggaaaagggctgcactaatggattaggagattcctaccttcacacctaaaccaggcagaaagggatagacttccctgttgcaatcctgtgctaatatgcaggtaattttctggtcttaccttcagagttctgtcctaatggaggaaatctcacttcccactcttgctttgtatggttccgagacctcaacttctgtccatgtatggacattgaaaatttaggtttctggctggcatgttggctccatgcttcgggaggtaatcccactactttgagaggacaaggaaggaggattgcttgaggccaggagtttgagaccagctgggcaacaaagaaagaccccattgctacaaaaaatttaaagaaattagctgagcacagtggcatatgcctgtagtctcagctactctggaggccgaggcaggagtatttattgagctcaggagtttgaggctgcaatgagctatgattcagcctgggaaacagggagagaccctgtctctataaaaaaagaaataaaaattagtcttatatgtttccaaagccaaaatccactccattcccacctgcaagcattaggtcacatgtttctggcacctcgattgaaagcatttttttttaatgctatacagcctttctaaacatttgcagcatgaacattttcaggttatccagattgttgtcacactgaccacatactctgacatttccacatcagcatttataacctcacctgggctgtttttttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcgtgagccaccgcgcccggccacctgggctgtttttgaagctgaactcaagaatatttccttagattcagcataaagaattggagagccaaaatatgaaatatatcctcttctaagaaatactcctaaaagtaaagttaacacctcaggtggccctcttggtgttctaaatgatgaatggcatatctgtatttcttcaattagtccaccaataccaaggcctccgttttctaggaggacttgggcacagaaccatggtactgcggcttacagcagcaagtgcagtcccattaacaaccagcagatggcgtaagtataaccatccccgagggaagggcccagcgctcctgagataggaaaggaggaagtcgtttattatttaaaggagagtttgaggacggacttgagctgtgtgaaatttgagatattcagggaagctgatatgtgttaatctgttccaagtaacacatgaaaatatcttttgccaacccaactctgtttactgttttaatttcctcaaaagaaaaaaagaagtgattgtatcaacagtgggacaggaggaaaaacaaggaaaatatccaaaggcagggacagaagtctgcaggttatattaataaaacattttaagcaggcaggtctttctttgaaggtgaagcacctttcatttgcttgccactctgaataaaaattacccctccaaacacaaaataaacacaacatttaccatgccctgccaactttgcctttgcatggagttaccatggactttcctcgttgtgaaaggaactccagccccttctgaaccttcaactgcaactctgagcgggtgagagtgcatccctactttccccactgttctggggtatggtaagacaggcttgtctaaatcctgtcgactccaaggacttgtagaaattccttgtgagacaagagtggtttgataaataattctaccacaaagacacgtgcaagggaatgttcattgcagccttattcacaatagcaaagacatggaatcaacctaaatgcccatcagtgacagctcagataaataaaatgtggtccatgtataccatggaatactgtgcagccataacaaatgaataagatcatatcctttgcatgaacatggatgaagctggagaccattatccttagcaaactaaccaggaacagaaatccaaataccacgttttcagttataagtgtgagctaaatgatgagaactcatgaacacaagggaacaacagacactggggtctacttgagggcacagggagggaggagggagcggagcacaaaagacaacaattgagtattgggcttttaataccttgaagcagaagttaaaaagagaaaaacgagttttcctgtacttacttggctgactcactccaaggctagcagtaggcagggccctagtggggccttgataacactatctgaaaagccagagcccaaaggaatgagctccagagactctcccaacacctcctcccccaagcaagtataagaaaaactgtttcttcgtatcagtttccccctttgaaattctttccctataccattatcctttgatctgctctcacaactacttttgtaactatttctgcaagtttgcaaggattttgtaagttcttgttttccagctgtgccatatggtgaaggtcacaagacaagcctgagttgtaaaacatgtcgctgtttggtaaactgcctttgttctgcttctgtgaagcttgcttgcccgccctgcaggtttcacgccactagctggccaactcccttcagttgcatgtataaaagtcaagccctgtctttgttcagggctcagcctttggatgttaatctgctgggccagtggccacctaaataaaatcttcctgttccacccattggtctctcctgtcccttaattcccacaacaacctgagtgatgaaataatttgtacaagaaatccccgtgacatgagttcacctaagtaacaaaccttcacatgtacccctaaacctaaaataaaagtttaaaaaactttatggtttggctacctcagttatcaagggtctcatcctacctcacatgctccacatagcaacagagaggcacccaggcacaggagcacacatgccctcaggtgcccacatgcactacatggagggctgcttcagtctctccttccctcagcaccagcatcctgggatttcccagaggaaaaaaaacgggagccagtctgagtggtcaatgttgaagcacagagggttcagaatggatttgcacaacagatagctctgtgtctaggaatatcctggtctccttcactcatggcccaggtcatctggcttttgggatgaggggtgctacatgacacacagggcaggatgtcaagatgaaaaagtccagtgtagagtttagtaccagaagagagaaaaaaatagaaaaaagtgtacagatcagggtgtgatgactttgatgatgaccatttctttgaattgggcaggttggaaaagaaaaataagcattgggtggggcaagtgcaggttaatctgggagaatgtggaaaggcacaatacaaagtaagagactgtatgttgatccctggagatgttcctgaggacacaggggatacttcattagcatgtaggctcagtgatagaaaggattcatcattttgttgcagaggaaaagttcattgctgtgagatgtccagttttcataatatgaaaagagcgtatgacaatgagtattactactcaatgatgagtaatatgtttttatgaatatgcatgtgtaaaactgagttttttaatcattatattgaatgtggttttccttactccctcttattgctgcaactctttgtgaaagtgatgcatttccctttatgagttactgattcaacaccctcttgtccagtttgtcacatttttctcatttctggactcacagttctaattcagttttctcctggggtttcaacatggttaatttttttcatttgctcctttttcacctttgttttaaatagtggtagaataaatcacacaccttcttgctttgcttgaaaattaacttttgcatcttccagtcaatagaatttttgtttaggtccttgaatacagattgagaaatgtaatggctaagttaccaaaatcaactaaattcaggtaaaacatttttgttttaattccattaagtcttgtttgggtttctttttctttgcataggtattaataatacttattctatttccagtctaccattgataaaagataaatgcactttcatttttctgaatacttctatttaggaaaacctactaaatgtgcagtgagtaattttaatattctattgaacactcactaaaattgcagtgctgagtatgatagttaaatggagacccagaggagaccccatctgtggacagttacaattgtacttagaccattttcctaactgggctctcctttagttccaggatacaagctgaaagtaatagtaataatctactctttagatttaatgtgaaaaataagggcaaatgtttaagctcctagaaatataaagttgtccaggtttttaatgctaactttggtcatttaaaaataatttgcaagacagaatcccaaaccagctttcttactagtgatagggcccaaactgaaaaactgctctctgctgatgcagaagcagacaggctcaccttttttgatcgaagtgagtggaaactcccctgaaaaaggaggtttttaagcagcaactaaacctcagcccccaactgaaaaacgctggaagatcagggattcctggaggaaagaggtcctggacttcagcaatcgtcctattggtttaggctacaaggtgcccaagccagcaccaggcaccaataggcaagctgctgcaggccaggtcaccttcactcaggatccctttgtggttaccggatgtcaactgaggaacgtgatgagacaagtctcagtcattttatgagatttattcaccaaagttaaggatgtgtgtccgcaacacagcctcaggaagtcctgacgacatgcgcccaaggtggttggggcacagcttggtttaatacattttagggagacatgagacattaatcaataaatgtaaggaagtacactggttctgtccagaaaggtggggacaactcaaagcagggaggggacttccaagtcacaggtaggtgagaggcaaaaggttgcattcttttgagtttctgataggcctttccaaaaggaggcaatcagaatctgcatctatctcagtgagcagaaggatgactttgaaatagaatgagaatcagatttgccctgagcagttcccagcttgaaggggcccaagatatcttcctttcacaaagtcttaatagaagctgaaggcttcagatttaacccaattactgctgttaaacattgcatacaatggttctcaactaggggtgattttgacccccaagggacatttgtcaaagtctagaaacagtttggtgataacagctgagggaagggatgctgtgaaatctagttggtaaaggccaagggtgtagcattctgaaatacacaaaacagcctcttgctccacccaacaaataatgatttgacccaaaatatcaacagcaacaacactgataaatgctgctacattgaactgtttttctaaaagtactaagagattaaaatttatatcacatgactaatttatggggattagaagtttttaagagctttgttaagatataattcacataccaaacaattcaacaattgaagtatgtaatacaatggtttaagtttgtttacagaattgtgcaattgccacattacgttctatattttaatcaccccaaaaagacaactagtacattttagtcatcatctctccatcctccctctgcttcccaccgtaagccttagcaaccattcatctactttctatctctatagttctgcctattctgtacatttcacattgatgaaattatacagtatgtggccttttgcatcttgttctagcataatgttttcaaagttcatccatgttgtctgtatcagtatttcattccattttattgccgaataatgggatttataacgatactgctgcagaaatcaggagaatggagagaccactggatggaaaaggaggattttattgagtgcactcagacccggcggattaacatccaaaggctgagcccttaacaaaggcagggcttgacttttatacacacttctgaaaaggggctggatagtttgaaacaagcttatagtggcgcaaaatgcagtgacacaaaagcaggtaacaaaggcagtttatgaaacagtgacaggcctgtaactcaggcttgtttaaacacatcatgtgactcctgctatgtggcccaggtggctgttatctaggcttgcccaagcttatcttgtgtcctttgctgtgctgcctggatggaaagcaggaacttacagaaaccagccacagaaaacaggaatttgcaaacttacaaaacttgccagggtatagcagcacatggggccggggcaggttggggggtgatggggggcagggcttcagctgcctaaaagaaaaaaaaattgtttttcctctttttaacttctgcttcattaccccctttgatgctttttataaatgaggtttaatagaaagaatcattattatttaattcttcatgtgaaggtagttagctctttatttggcaagggttaatatttagttagagccattagttgagtggcagtttgtttctctacaagagcctctgtagctgtttggatgttcttaacaaggagaggtaggagacaagggagtatgaggcagactcctagtatggctaaaactattcctactaaggttttaaatcctctgagggataaaaaccagcccccaaagagggaatctgaagaccatcttttccaagcctggaatggaacatgggctaatttttggatttttgcagttatattcttgatgacctttccattgtcatcaatctctaggcagcagttagttaaactgaactttccacatacccctccttcctcagctagaaggtagtttagggctaatctattttaataaatagcattccttatttttgtggcttgctgggctagcagatttaaggcctttactgtatcatttgtcataattttaagtactgcttgtaaccttatgatgtggttgagcatgtaaagagttgtgtggtattccctacattccaccttctgcccaggtggctgggccataatattggattattctttcagggggccattaatcgtccttgcatttccctatggttatgccccttttatttctccttttagtttcatcatagacagggtaccctaaggcttctccttgttttaaagggattagaaagaaagacggtctaattgttcctagtacacaggcccttggccatttaactggcagttgccgatatgcccacagtccacaaattcaatagaggccggagggtgcctgtcaggcatttggagcttcaagttggtaccgagagtagcatatttatacccagcaagggcaaaagaggtctttaccctggggaggtggctgagcaaagtggcaaaacagcagtaaaacactaatattataaggaaagctactggacttaagatttctaaccatattgacttccctgatgatgactcgagcttcggccatgtgtaaactagtcagcttccagggtgactagagcagggctgttgcctcctcaagcttcggccgtgcgttgactggtcagcttctggagtgaccagagcagggctgtcattgtcttcaatggcaatttggtcccgtcgtaggattggccagcacagatggtctggatcctgttggctggtccattcatctcaggccgctggcttcagctgactgtggtggatccatggtacaattactgcaactgtaacggcagagtgagtgggcaagattacagtatggggcctatcccatatgggtctcaaagtggttggattccattttttgacccaaatagcatccccgggtttgaaggggtgtgccaggtctgtcaggcttatgggcattctttcccatacccagccatagacacactgcatggctatccctaaagcctgcatttgccttcttaaagttagttcccctagttcatggagatcacccttaacttgacctataattggggttgccggccgaacaagatttcatagggtgaatacctggtttgtttggtgggggtgcaccttactcagaggaggaccatgggcaagacctgatcccatcttagatgggtctcttgacaatattttttttagtagcgtttgagtgtccagttcatgcactctatgttttttgagctctgcagctggtaggctgtgtgtaatttccattttatttttaatagccataccagttcttgaactatttcagctacaagtgctggtccattgtctgacccaagagttggggcagtccaaatcttgggataatgtctcttaacattactttggttacctcccgtgctttttctgtttgggtggggaaagctttgactcatcctgacaaggtgcagaagagtactagcatgtactaatagccccctgctcagggcagctttgtgaagtccataagcaggttttcacagggtgtggctccaatttcctaaattcccaggggccgagtaggttattatgggtcattctgagcacatgttagacattgcctgcacacagcttgggtgagggcattgagccgtggcacatagaggtggcatcccagtagcgtttgtagtgccgttttccccatgtgagtctcttggtggaattgttttacaaacttaggggccaccatttcagggatggctagtctcccatcagagaatttccaccatcctccttcagtgcattttccagtttcttgggcaaaccaggccttctcatttggagagtaacttgggatctcggggagggaaggttctgggaggagaagcatagctaaggattccttttcaaagtgtggagtaatcattgctgtccgttttgcctccctgtctgcctttctgtttcctttggcctctagtgttcttgctttttggtgccctctgcagtgcataacagctaccttctttggggcctatacagtacctaagagctgtaaaatctcctctttgtattttatttctttttttcccagcagttaagagtcctctctccttgtatatagcttcatgaacatgcaatgtggcaaagacacacttttgtctttgtgatttggaatcagtgtaaatattgacctttttgtctctcatcagcaaaagagcccttgttagggccattagctctgccttctgggctgatgctccggtgggcagaggctgagcctctatcactgagtccaacgttaccaccgcataacctgcccaacggaccccttccagtatgaaactgctcccatctgtgaactacttaacaactgggtccctgaggggttggtctgtaaggtctcccctactcaagaatacttcatctaccattttcacacagtcatggagtggggttcccagttcaatcaggagcaaggtggctgggttaagggtgtttactgtttctaaagctatgtggggatttttgcataggagtccctggtactgagtcattcctggatttgataaccagtgatgccctctctggttcattagagttataactgaatgtggtaactggatggtcagctgctgccctagagtcagtttgttagcttcttgtgccagtagggcagtgacagctagtgtcttaaagcaaggaggctaccttagtgccactgagtctagttgcttggataagtatgccaccaggcgatgccacaatcctatgaattgagtcaggactcctacagccattcctttttgttcatggacatatagaaagaaaggctcagttatgtcaggcagtcctaagactggggcctgtgttaaggcttctttgatttttttaaatgctttctcctggtcagcctcccagaggaggggttccttttctctccccttgaatctggccatgttcagtataatagaggggtccctgagtttcccggggaggcatctgcaaagcccaggcatggccagactggaggcagcaggcttgatcatcctgactttcctccttgacctggggcagtggttttgatttttctttttgaggcaaggcccagggttcgttaccatttgaatttgactcctcgggggctggccttagtaaaggcgggtagattggactgtagggaggattcctatctcctctggtgattcctgcagaactggtttttcctgtggctttccctttgtttctgtagctgacagcgaagctgatttttctttcactttaagcttggcttgagccacgagtgttttgccataagctgtcaggcagagctgcaaccacgcaggtcagttttggactatatgtagccatgagtcaatataaggaaattggtctggatgccctggctgtcctcccaacccagtcaccaccttaaatacatggccaattgtttccctatctatagttccttcgaccagccatctcacaccaaaagaggtccattctatttcacagagagttctcaacctctggggggtcaacttgatcccacaacactctgcataacttttcttgaagttctttaacatacattgtaatggggtgggttttgacagcttccttcccatttcctcccagttatgacacaacttattcactcttttactttctcttcagactgattagaccatctccctcatgggaactttcagatgctgcttagctttaatggagggttcatatgagtcccaaacctggaccaccacaatcactgaattgtggggtgcctccctaagccatatgtggtagccccggaggacgtttgccactagtcctggttggtcccacactttgctaggggcgtatggtctatgctaagagacctgtggccccacacacttcactccccacattgactccttttagaactgcctctttcacatgcattcacacacttccctgctccccattccttttctctgggtggggtgtaggtttcatccgactttgtgagccactcccacatcctgggtcagactactcagtgcacccctaggagttgatcaggctccccttctgtccttatgggatgggtcctgtcttgggccccaaaccttaccacagtcctgtggcgcactatccctgaaatcatcctgtaatcccttggattctgttgcgctgtcagggaggggtactggatcacggaagaaccaatcccttctctgggtttaagttccccgatggcatgcctgaggtcacaggtctcccccagctcagggccccagacccacaggcaaaggagacagcaaacctgtcatctccactcctggctggttcaccaaaatattgcaggaatgaggagactggagagactactgggtggaacaggaggattttattgagtgtgctcaggcccagcagattaacaaccaaaggctgagtcctgaacaaaggcagggcttgatttttatacacacttctgaaagggggttggctagtttgaaacaagcttacagtggtgcaaaacgcagtggcgtgaaagcaggtaacaaaggcagtttatcaaacagtggcaggcctgtaactcaggcttgtttaagcatgtcatgtgactcctgctatgcggcccaggtggctgtaatctaggcttgctcaagcttatcttgtgtccttcactgtgtcacccggatggaaagcaggaacttacagaaaccagccacagaaaacaggaatttgcaaacttacaaaacttcccaggatacaatagcacacggggttgggtggggggtcggggtctcgagttgcctaaaggagaaaaatttgtttttcctctttttaacttttgcttcaataccacattttgtttatacattcagcagctgatgggcatttgggttgcatccactttttggctgttctgaagagtgttactgtgaacattcatgcacaaatttttatgtggaggtatgtttttatttctcttgggtatataactaagaatagaatgattggatcatataataactctgtatttaatattttgagaaattgccaaaatttttcttttttttaatgttaccacccataacgtttgaacattccaatttctttgcatccttgccaacacatgttattatctgtctttttcattataactatccttgtggttttgaagtagtatctcattgtggttttgatttgcatttccctagtggctaaagatgttgaacatcttttcatgtttttattgacaagttgtttctcttctttgggtaaatgtctatttagatccattattgttttttaaactcagctatttatatttttattgttaagttgttaaaaattcttcatgcagtctggatatgagcccattatcagatatatgatttgcaaatattttctccccttctgtggattgtcttcttttcactttcctgattgtattatttgcagcacaaaaatgtttaattatactattgtccaaattatctatttttctctcttgtcagtttttttttgtttgtttttattgtcatctctaacagcagttcacaaagtttgctttcatgtttcctctcaagaatttcatagatttagctcttctatttaggtttatgacctacctcaagttaatataatgtccttagtgaattatcttggcactacttattgaaattaagtagtttacttttgggctttcaattttattctattgatctatatgtttatccttatgtcaataccatactgttttgtttattgtagctttgaaataagttttgaaatcagtgtgagatcttcaatttagttctttttcaagattcttttggctactctagttcctttgaattcccatatacattctagaatcaccatgtcagtttctacaaaatagccatttggaattttgataggtattgcattgaatgtatagatcaatttgatgagtgttgctattttaacaataacaactcttccaatccatgaacatgggatgtctttccctttattttggtcttttaaaatttctttcaacaacgttttgtagttgtacaaagtgttacattacagcatcatagtattcactgtgaaagtcttataatttttcattaaatttgttcccaagtatcttattctttttggatgttataaataaaattgctttcttaatttcttttcagattcttcattgctagcctataacaatgcaattaatttgtgtatatttatcttgtataatgcaacctttctaaattaatttattctaattattaatagtagattacttaaaatttctacataccaaattatgtcgtatgtaaatataagaacttttccttatgtttttgcaatcttaatttttaagatttatcttgtttacccaatttcccaggctagaacctccaatatattgttaaatagaagtagtgagagtggacacacttatgctgtacttgagctttggggaaaagcattcagtctttcaccattaagtatgatatgagctgagattttgtattgtttgttttgtttttgtagatacccttcatcaagctgaagaagttttcctctattcctagtttattgaatagttttttttttatcataaatggattttggattttgttacatgctttttatgctctattgaaatgaccacgtgtttttttgttcttctttctattgatatggggcattatatcgactggttttttggatgttagaccagcattatatttctgagatatatcccactttgtcatagtgagtgtgtaatcctttttgtatgtatccatatttaatttgcttgtattttgttgagaacttttgtgtttatattcgtaatagatgtaggtctggttttcttgtgatatcttttgtttttgtgtccatataaccaacctcataaaatgagctaggaattgttttctattttttcaaagagtttttgaataattgtaataatcatttgaataaataatgattctttaaataattggtagaatgcactagtgaaattatctgggtctgggcttttcttctgggaagttttaaaattactcattcattagaggtttttttttttttaagattttctatttcctcttgagtcagttgcagtggtttatgtgtttttagaaatttgtccatttcatttatgtccatggcatacaatctttcataccattcccttataatatgttttatttctgtaaggttagtaataatattccctctttaattctcgattttaataatttgagtcttctctctttttttcttagtcaatcaagctgaaatttggtcaactgtgttggtttgaccaaggaatcaacttttggttattaagttttgatataacttttctaatctttattgcattaattagtgctctattttttatgtattactttcttatgcttactttaggtttcattttctcttatttttgcagtgtcttaaggtggaagtttgggtaattgatttgaggtctttcttcttttataatgtagatatttatggctatacattttcttctaaacattgctttaactgcatccaattcattttagtttggtgtgtttttgttttaatttatctcaaaggatttctgaatttcccatatgacttcttctttgaatcactggttttatttatgaatgtgttatttaatttccaaatatttatacatttttaaaattttattctattattaatttctgatttgattccaatgtcattggagaatatactttgcattattcaaaccttttaaatttactgaggcttgttttatggcctagcatatggactgtcctgaaaaaagctccatgtacacttgaaaagaagatgtatattctactgtttgtgggcggatggtctatagatgtttgttagttctagtttgttatagtgttgtttgtttataattatatatcctttataaccttcttcccattctatacattattgaaagtgagattttgtagtccctaactattattgttgaattgtctgtttcttccttcaattccataagtttttgctttatgtattttgggacactgttgttaggtatttatatgattataattattacctttttctcatagattggcccttttatcattattatgtgtcttccttatctccactaatattttctggtcttaaagttgattttgtctgatattagcataaccactctggctctctaaagttgctagtggcacgacatatcttttttcattcttttactttcaacttatcctctgtggacaatatatagctgaatcttgtttttttatccaatttaacaacttatgccttttgatttgactgtttaatccattcacattgcataattattactgtgattggatatatgtctgccattttactctttgctttctatatgtctcatatcacattttgttcctctgttccacctttattactttcttttgtattaaattaatgtttgaagtataatattttaatttttagtgatttttagtatatttttagctgttttcttagtggttgccctagggctgtgtagactgactaagaaaaaagagagaagactcaaattattaaaatcaagaattaaagagggaatatcatcactaattttacagaaataaaaattattataagggaatagtatgaacagtttatatattaacttatcagaatgatgtgtactaccttaatgcaagtaaaatatagacactttactcttacatagctctattctctcttcctcttttttaatattgttattatacatattacctatatatatgtaacgaacctaaaaatatattgttataattattactttatatagttttatgtcttttaaagaagctgagagaagaaaggagagaaatacgtatttgtagaatttctttcattaatcttcttatttatcctttctgagtctcttcatttatttcctgtgcattcaggttaccaacagttgtcagcttcctccaacacagctccactccctttcacctcctttgggctctttttgataaatatgttagattttatctttgttataagccctagattatattttgagtgaaaggtctacaccaagcttgtccaacctgcggcctggggaccacatgtagcccaggatggctttgaatgtggcccaacacaaattcataaactttcttaagacattgagggtttctttttttctcatgagctatttttagtgttagtgtattttatgtggcccaagacaattcttcttcttccaatgtggcctagggaagccaaaagattggacacccttgtgtccaattattctacacaatatagaaaaatgattacttactgcagccctgggttcctggccgactaaagagaaacacccaatagaaacaacttccttctagcaagaattaacaatggtaattaagagactttgtaactttgtgatctgttcaaaagactgcccaaggctaagcctaaaggaactttccaagttattaacgagagtttcacaactctggagccttttatgaacaggacagcaatgcactgaaactatcacaactgcttcaatgtctgatattcctatggttatagagaaccaacatgaatattgcagttagaattactagagagctctttttcttatataaacacttcaacaaatatgagtttatgcataaagacatcttttttcagaagctgaataatgagcaaatccttttttacaatgttttatatttttgaattttaaaatttgttcagcatcccgagtcagacaagtaagaatgaaatcaaacgcaaatctggcaacagagatgttttgtgactcatgagtaagccattcaggtacagacaatacctgtcaggcaggttgggtgtgttgctagatcactttctccatgctcaaacacagatatgatgtctcgacacccacataaggtatttcatgctaaaatcaagaaatactgggagttccactgagaccttaactttcaggaaaaataaaatcagtgtactcattgaagagtagctataatcactctttggacacagaaacgttgcactcttttttgaaggttctttcttgaagcagacgtttctttccatttctttttttgtcagaaaatcatttcacaaactgctttgagatttaactaaatttcttatttttttttttttaaagttgagctgggactgggcatggtggctcactcctgtgatcccagcactttgggaggccgaggttggtggatcaaatgaggtcaggagtttcagaccagcctggccaacatggtgaatcctcgtctctactaaacatacgaaaattagctgggcgtcgtggcacgcgcctgtaatcccagctactcaggaggctgagtcaggagaatggcttgaacctgggaggtggaggttgcagtgagccaaagtcgtgccactgcactccagcccaggcaacagagcaagacttcatctcaagcaaaaaaacaaacaaaaaaagttgagctggaatttgagcttatttattattccttgaaaatcaagtgtagataccctcgattgctaccatagggagtgccacagcaagagctcagtgagtataatttgtcctcctgtttttttctttgttttgattgcacatttactctatcaataatatgaatgtttcaaattttgtctttgaaatgtggactagcaaaattactaagatactgagtacttaaagttacttataaaataccgcttaaagatatcaacatctgttcatctgtaaagcactctagaagttgtttgcaatttttactgacaactaagtgaaatataaagataaaacatttggatctttgatgagcttcaattagaaatgtttttttccagaatatatcatttttctaatgataaatggtttagattgtgttaatatttctgttccacaattgtattatttccttttgcccatagactttttattcatgcatttcttcaaaaaataaatattatattgtttcatcccaatgcttatatggaggcccaggaggctctgcatcccaacccctctgttttctgtcttacctgccaggtcaggatgagaaatgccattgggcttattgaggcagggatggtgagtctagctttcagtttcctgtacctggctgacatgattttcttcaccgtcacttgctctggctggtatttgtatccatatagaaaaatataaacataacaaaagctttggacaaatgaaatcaaattctaattctattagaaggcacctgatgtcattctcttaatgactttttagagtattactgcacaaataccctccaccagggggtaggggaggaagcctgtattctcctctgtctgcatatctagtactttgctagtggctgacttggtgctccataaacatgccgtttcttcctgacactttcattttcttaagcccattaacagcatgagatagacacatatgggtggattcccaagtcagatgctttgttctgaaactatctttaaaatctactgtagactgattttcagaccattttccagtgatggaaacaggctctccctgtgaatttatgcagccttgtttcccctaacgtttcacccaaaatgaggttagccctggaaattccagtgtcccttagctacaggggccctccactgagaatggcttactcctatgtgtggtacaagtattatgtttgttgcctgttcacatcccaggaaaaatactgatttctgctcctgaagtcataaaagattattcaatcataagccttatgtttgggattatcttcaactataagcggctgcacacattcagcttgttcttcctgactgaagggtccagaagcagacagtctatgggtgggagggtaactcacaatgtcaccagggacccagttccttttcatttctactcagtcatccttggcacaggcgtggtactctgtgttacaagagggctgtttggtccaccagcagcaagaggaagggaaaggggcaatgggcaaagatgacatgtctattggcaaactcttctaaagagatttcccagaggcaggacgaacttctcacccaaaatttggttcagatgttgagactgatgataccatatatgaatccactaagaaagtatggaaaggtttattgcttacataatgatccaaaaatagctttagaatccagagaagagagactggcttggcgtttattgtgggtagagatgaggctggggtgaaggcttttgcacaggggtagaggcttgtggggtttaaatttcccaccaattccaaaggagggagcacctgggccttcttttcagcttcctggatatggaacaaaaggagaagagggagtaatgagatttgaatgcagccagacatcagaaatgtagtcagactctttattgcactgtctcaatacccttctcctggcatcttacagcaggctgagaaatgtggtgttttagtggccacaatggagggctgttagcacaggagtgcaggatggaggtgagcgggggggcaggcagcagactctgccagcccagccatctcgtctttcctgctgacctccattcaaagatgaaaagtgaccttggctgtccacaaggatcaatggtgttgaggtacctggctcacttttgttacataaccaagtccagtgaactacagtaatgtagccttttccaaagcttgaaggagcaagaggaaaaccatgagaaggaagaagagagctaccctttgggacacagcagggcccagtgagtgtgttcagctataaatatgggcatcctaaagatccatcgcaatggtatgtccttctgttaattgcaaagacaaagggaacacacaagctaaaaacaacaacaagaacaacagtaacaataacgatagaaagcaaaacagcctaattctgtcctctaggctggagactgtaattttttccccaccgtaggatactgttaagtttattctagggtgagtgggtgcccaagggaggcagtgagtatggctgaagtcacctggtggcagggtgctcagggatggccacaagttctacacggccctgcaggacctgagtctttagtcagttgggaagctctaccttctgccccagcccaagagggttggggcagtcacggatgtagcagttttcgtaattcacagggatccatgatgagcattgagcaggcttgattctcacacacatacgcagtggcctggtcttcctgccttcggagggtactcaggaaaggcagccagtgggacaggaaactcgaggggtccccatcagccagaatcagcaccatgttaggaatgtagacagggtggacgcactgcaccagaactttggtgtccttggcctggcggtctccacagatggtgatctgcctgagggtctgctgctgggctgagagggcacggaccatctccggcaatgccaccgggacatggtgcatgtgctgggagaaggcagtcactaggcacacacacttgtccatccagtccttgtgactcgtgaagctgtgcaaccagagcgggttgtgggctgacacggaattggcgctgggctctggagactgtaatgttttaaactctaggaggaatgtcctctgaaagattgttcagaagaggaagttgttttccccactggaaggaaaagaggggagaagagtcagaatgattagataaaagtgctttccaatatgttattgtccagagcgtggtgtagaaaaacaaaagtatagtaaaaaatgattctccctttcagttctctctttaacctttctctctctctcacatttttgtactcagatgttgctccctgcttaaaaataattctgcagttgaaaagcaagtcacttgggaagatctgcaagttaaagccctaccaatagttttcaaatatgacaataaatgtctgggtggtgatgaagggtgacttgcagaagcaccattttccattgagaaggtggttattggcttgctattagaggaggaagaaaagatctatgtttatggtgctgatggagaagcattcagaactagctgcttttgtgtttaatatttcagtgaggcaggtgtccctaaaggcatgttgacacttacctctaaggattcaaccagaaatctctttgatttgacatttattttacaactttgatgtttgtgaccactgctcagttcccacaggttgctgtttgaccacgacaaggtcacaaagccacgaagccataaaatatgttcaattcaatagctagttatggctctcggctcagggaccccacctccccaaaaactagcagtctagaggactcccttggcagagaatctgagcacatgcgttctgcgaagcctcttctggggtcctgatttatttttattttttcactttctcccctttattctcttgatgagcttcaaaaaaaaattccattgcagctggcaaggccgaaaaggtacttaatttcaaccacatttttggtaccctaggaaaactaattagaaataatatacagagaacaaggtatggcatagatgcacaagatctttgcaggccagtgagcaaaccaaagatacgagaaatcgtaggtctgccaaccttatcttaaagtaaaaaattgagttacaaacaaaatacaagtgccaccactcctagtgtggagaagtcagcttgggcccatatcccaactttaagtaaagtagaaaacatttattttatgtctgctttgccgtgactgccctacagtggaaacaggacatttttgccatgaatttatcatttgatgcagatgtttggctcaagtttcctgatcttgtcagcaaagttgacgttaaaacattagaacaagaattgtggtttatttacgttttcttacaaggtgtaaatttgcatatatgagctttgtttttattgcagcctcttagcctctagttttggagtgtatgccctattttttctccatgaatagtttgatagttgtacttaaatttatgggttctttctacctctttctacctttatttctccaagtaccagcacattttattacagtgattgctgctttcctgttatttttttaatggccatcaagaaatatagactcccatcgtagcattgcaggtggctaaccccatcttgacctctagacttttctaagtctgcaaagaataaaaacaaggaggaatttgcaaagttcatcaagtctagaccttccttagaggcctaatgattatatttgaagccactctggccagttttcctgattggaaatggttaaaaagtagctaggaagttctgaaaaagcaaaagtggttaagataacaagttaagcattagcaaggaagtttttcttcagttcaagtattaatacatggtctgggctttaggagtaattttacaccagttgtctgttttcctttcagaggtggatggaaagttgttctcaaaatgcatctgagttgttgaatatccattatgttacagggaagccattccttcttccaaaacagttttaatttttatggagtctaagttaaaacaggaacatttattttcttatgggtaaagttcctggaatgctctattacatggatttagtacattttttgaccaaataacacttgaccaaacattattttcaaaattgatctctctttaaaaaacaaaaagatttaaaaatatggttccttttgctgatgagcatcatactttggcatttagtctgtaaaaccttggcatttagtctgtcttcctggagctcagtttcttgaaatgcacatctcgcattcagggctttcatactcaacaggtggtaccagccactggtgttctgcttataataaaaatgatacatgtgtattaatattgctcttgaagttaataaacacacccaaatctggttaatttgttcaaattattgacagattctctgtgatttaccaggattaatgagtatgcaaatacaaggaagaatgcccaggatagagaacatcatggaacatattgtactttattgtaaaataaaaatagccctggacagcccatggaatgcgttctaacagcataatcagttctttactgtggttttcctgccaggcggggagccctgtgtcacacagggtgggtgccaagtgtctggtttgcgctttggtaagatttttctttttcttcctgataattttcaggtttgcagtttctccaagtgcaaaacatccaagccaccctccctctgcagtggagtattgattttgttctagatttctcagcaaaggttgggatattagagttcaaaacacaagtgggcagggtgagcccacagtctctgtgacggggcctgctggacactcccagtctgccggcgaatggcagaggcctgggacagcacggtggaattttcatctcgtgcaaatgaacttggcctcttagatccaggtcctctgctaccaacagtgaatttgttacagtgtgaaatgctgaggcaactacctaaataaatctgggcaaaatatactatcgaagcaatctgggatttccacccttcatgaattatctcacattttagtctaaattgtttaagaatgacttgctcacggctgggcatggaggctcatgcctgtaatcatagcactttgggaggccaaggagggcggattgcttgagctcaggagtttgagaccagtctgggcaacatggtgaaaccccgtctctactaaaatacaaaaaaaattagctggacattgtgatgggcacctgtaatcccagctacttggaagactgaggcaggagaatcgcttgaaccagggaggtggaagttgcagtgagccaagattatgccactgcccttcagcctgggtgacagagcaagactccatctaaaaaaaaaaaaaaaaaaaaaatggctttctcccttgctccctttttgccctctgtccacatggtcccagagtcggtgtttgaaaagcggctttccactgtccagagaggattattcttaacaggctgatgatcctggagcccacggccacacttctgggctctagtcacctctaatccacgttgtgataattggtcattttgttttgtgcaggcaagacttggatgtgcaattttcataccatctcttgattgtttacccaaacagaaaatgtaaccagggaaccagcaatatggtagttatgcacttcccaaatcaacttgaagttgatcctaaatgcacgctgtttccactgctgcttctctgatgcaggttctgccccagtgatagtgagctggggttactgtgaaccaagattgcacacggggctatatgtggaaactccgaccccatggtgcctgccacacactcacacacatactctttgagacccaaccaaaccagcactcagaggcaaagagtttaaagaggtggggctttatccaacattggaaccattttaaattccccaagtagctccatttcaagttcttcagatggcctatgaagatcgataggacgtctttccctaagcccttgccctcgtgcctctcctgacacacgcccagcatctctcttctggaggccttccctgctaaagctctttctgtgcaacttcttggctgactcctccatccccaggaggctctatctaacagcagcctcatcagggacaccttcccctcctgccacctgctctgtgttcccccagcccacatcttcattacacaaactatttgtatgctcacttataagcttaagggaaagagacagtaagctcgtctgggtaggaagtctgttttgtttactgcagtctccatatcctatggaagggtgccgggcccactgtagatgctaaattaaaacctggtaaatgttgaacaaataaaatgattaaatcaaatggtgtagtatgcaaggaagaaacaaagatagggattcaagccctgcctctctacctggctgtgtgacttcagctcagttattgaacttctcttgcttttaatcttcttatcattataattactgagatttgggccacgtttttagaaagttaagattttgtgtggctttttgagctttgacactttaaaattgtttatcttcttttctgattttttttttcctgctgggctgtaattttcttaagggcaggattattaaagatgcatctgtttatttcctgaaattcacaggacaacacttacactcaggtgctcaataatcatttgttggaaataacctgttttgttttttccccagaaagcctgtttcaaaaggtgtattttatagtatttgatctgctagatcgagggttggcaaactttttctgaaagaagtccaggcagtaaatattttgagtttcgcggccatactttttgagatggagtatcacccaggctggaatgcagtggcgtgatctcggctcactgcaacccccacctcccaggttcaagctattctcctgcctcagcctcccaagtagctgggattacaggagcctgccaccatgccctgctaatttttgtatttttagtaaagacggggttttgtcatgttggccaggctggtctcgagctcctgacctcaggtgatctgcccgcctcggccttccaaagtgctgggattataggcgtgagccaccatgcccagcctatatttctttatcacaactctgcaactctgccattttagcctgaaaacagccataaacaatttgtgaacaaatgggcatggctgtcttgaaatgaaactttatttgcaaaaaacaaatgacaggctgcatttgacctgggagctatagtttgctggcccagcactagacggttattgtcataaaataaccattttctaaaaacgaactctttgtttccactgtgtttctgagtaagttacatgagatcatttaagtttcatttctattgttggccatttgttatatgaataaagatttgctaagtgaccctcaagcttgggtctttatttcatttttagattatataaggcttgacccacttaagaaatgtaaccgtctttttatttctcctattaattttttttttgtctttgtgactatcttgtttatacaaactgaacctgagacaaagccgctagtgactgctttttgtggttaaactggtttcgaacccaccaaagtctagaagagggaaagaaagaattgtaccagatttgatgtgttttgtgtaacgtaagccagattgtacctccttctctctctcccaggtctgtatacaacttaggaccaagaggtggactttggtgtcttagttcaagctctaaaaataccagggaagcagggaccacgacacatcccaggcttggtgcagaaacctgacctgaattggaccttaagatcagaatatagatctattgtctttcctcacctggctgttaccaaactaacttccgcatctcctgggagtgctttctatttcatccaggcagtgcccttatctgatctggagtgggtttatctctgggagagctattgaagtgcctgacaggagaggacactaagagtacctccagtctccaactgcctcctccggcagaactgagcaagtcctaaccatgccaaaaacatcattatctctggttccatcttagtccctgcacaccctaggattcaaggactcaagtaagttggggaggggaacatcttttcacccctggaaaaccttgtctcctcccaagccctgggaggggagaactgctgctaatgagatgctggtagttagtcttgtaatttttacagtattatctgcagaatgaatgactaccagcaggtactctgaatctcttttctttctaataagatgtaatcaacgaaccagattgtggccttggagctgaccaaaggatcagctaaaggaattggacacatcctgagctagttaacacatgggtattgtcggtctaagatgctctttaggggctagtgactcattcatgatgtgcaggaaatggcacagacacctccatgaccacagaaggtttctacaggcgccgtcatcacagggtctacaaacagaaggaagtcagagagagaggctcaggggaaggcaaggcggggctggagacctggattctacgtcggagtttaccgcatcctggttctattcccaaagtcctctctgtgtggccatatgcctgattctcagcctggcttcattccagtcatctcaggatcttacaaacaacattgatgtccaggccccaccccagaccaatgaaatcagaatctcttggacattaaaaaaaaaaatgagtgattctttctgggtgattctaatatgtggtcagggttgaggccactgctttacttcattacatcatgacactaaaaatactactggaaagaaaaaaggagggctaccatctgccttccaatctcttcagctgggaacctcttcataagactgtatctgaaaccaggatacgagatccttataagtaattccatttataataacaaagaaagaaaagaaagaaagaaagagagagagagaaagaaagaaaggagggaaggaaggagagaggaaggaagggaagggaaagagagacagagaaaggaaagaagaaagaaagaaggaaagggaagaaagaaagaaggaaaggaaagaaagaaagagagagaaagagaaaggaaggaaggagaaagagaatgaaaggtgtttacagctggaaatcaaacagaactttgcctgacacatgttcatttttggccatttttgccttttttgtggtgtgaaccattagttcagcccagttaaccctgagaccacccacaaagactgaattcagaggtggctgtccagtacagtgattcaaggtgaggcctgtgaagtgagatcaagatttgaatttctgcttctcagttcaccaactatttgaccttgggcaagtgacttaattcaagacttagttttatcatttataaagtaagaagaataatacctgtcttacatactctgatttgttgatatgatagtcaatatgctataagaataaattaataattaaatgacacggtagacataaggcatttaaatctaattcctgatccacagcaaaccttcaacaaatagcagctgttatcatcagagctaaaacgaatcatgtatctaggctagggtctggtttctttgctgttttggataatggcttaggaataagaataatgcccactgaagaagtcttgatttttcttaaagctctaagctcactagagttttttgcgtgttgccaatttcaatcagatccaggagtattggttactgttggcctatatgatgaagattaacttttggaagaatctttctgtggaatgcaggccaaaagaattctgaggctgcttttgatttgctttgagttcgttgcagctaatgtgaaggatgcaaatatttctatattccctactatctgcttggggtcttcaagagatgagttacagtgacctggaggtaacattttaaaaatgctagttaagattagtgttaaaaacacagacaaagtctgaatctctccaatgcttgattttaatttttaaaaaagaggaacatattacaaaggaagcagaatttcaacataatctttagatggtaaattatgttttacattagtctgcattattaccacaatacttgcacctggctggtatgaggagtgtgtgtgtgggttaaagggagctgttatttacctgcttatctatcagactggtaataccaatctcactctgcaaatttaacatcagggatttactgttcataatagaataaatgcatattgagaaccacacttgaacttagcccttctgacaggaaactttcaaagttagaagttacactgagcttgaattttaagagagaggaaaagtcatttaataaaactaaaaaatgaaggatggatggatggatggatgcataggtagatggatggatgcataagtggatggatggatggatgggtgaatggatggatggatggatggatggatggatggatggatggatgcatggatggatggatggatggatggatgcatggatggatggatggatggatgcatggatgtataggtatatggatggatggacagatggatggatggatgcataggtagatggatggatggataaatggattgatggatggatggatggatggatggataaatggatgtatggctaaatggatagatggatagatgcataggtggatggatggatcgatgggtaaatggatggatggatagatgcataggtggatggatggatggatggatggatggatgaatggatgtatggataaacggatggatagatggataaatggatggttggatagatgcataggtggatggatgtatggatgaatggatgtatggataaacggatggatagatggataaatggatggttggatagatgcataggtggatggatggatggatggatggatggatggatggatggatggatggaaagatgcatgcatgcataggtagataaatggatgaatggatatgtaggtagatggatggattgattgaataaaatgctgaagttaatagaatcctctgttactctgtatgcccatatgttcttcatggccacatgtaaggttagccttatgatgaaagattggcatcagtattgtcatttttatttcagcttgtgcctaggttacatgttctcatatgttccccataaacattcacatggtccagtgtgcaactatgaaagaagcttcccatcacctgtgcctcccaatctcaccccactcactgcaatctgaggaagaaatccaacaccaaacaaacactagaaagcaccttgctggcgtgggcttcctgttaactaaactaaaattccatctctaggactcagtgaactgacaagtgttattgcttccaaacttgggctatgttcactccatccaggtgcatttctacaattcaagtaaacattttcactgtaaacttattgctagtaagagcacaccacatcacaaggaacagcaaatagcagacatatctttgcgccttcacacagcagcacagaaattatatctggtacttgattcagtgtcaggtggtataagcacttcatcaacaaatgaagaacagaaggggtaactgagcagcgacaaatatttcgttaagttctgtaaccaagataagagatagattctcacacttgattgctgggaatacacacatcctataaaagccaagaaagttagaaagttaactaagtggcacaaactttatagcttatcagtacaatgcaaggcacttcaggaaaactggcatgataaagcttggtttcctaggaacaagctaattaaattatatttattcaagtaatctaaactatttaactattcaagtggttggacaataaaagaactagaataagactcagaaaagcctagtacctacattgctctccctgggaggtgcagcagcactttgagggcatgcaaattgtttaagatattttaaggcagctcaggatctctgcatacattctagtgaaaacagcagatcttgaaggaactggagtgcacggcttctgtgtcccacaattcaaacatgagaggagatgagaactcctgtattataagatggctttgcacatgattgttcctagaggtgagttttcaggcaaaacagagggagctccctgtctgagtgcaaccagcaggaagaggaccttgatgctggccacctttgcccctcaccatggagctgcattccctgatgtcttctgacagaacacacgtggtgcaggacaattcccatgccttcccttctccaaactgcataaggaccctgggaggtaaactgtttttctcagttcactagtgcaaaaccatctcagataagtcaatccgcttgcctcagatcattgagttagtaagtagcagctctagaatttgaatctatagctaagaccaaacctacatttctcccttgcacccccaatggactttactccttgccagaaagaaagaatataaccatttagtgtcccaaggcaagaattacagcttcggttcaattttgctgttggtgtccacactgtaaaatgagatttgactggcaagataagacataccactgagcaatttgaaaaacaaaacataatgacttttgcccaagagattgcaatgattgtttaaattgataacccaagtactttttctgatgtgcgtactaggtgatatatgttatttactgattgataaatggtaaggctgcacctttagaattactgctgcctactaagtacacacagatttcagaagggaagtaagcagaggtgagttttcagtcataactcaactatcactctgagttagggtgaccacaatggcaaaccaaagccagtggaacagaatggatgacagataggaaatattctccagcatgtgatcaggaataaatgcatggaggtgaaacaactccaggaatttttcttaatgaagaagtaaagaaaacacagtcactgcatgtctagtctgtataggtgtggtcaaacaccaaggaaactaaagactgtatgtttgactttaatttcagaagcctgactttggctcagtcataattctctagcttttattcttcaggtcagacagtcaaggagaagaaaaataagaaaaaccagtaccctattattaggcattctttatcatctctttttcagctggagtctccatcatctctacgtgcacatttgataagctgaagtgcaatgatagaataagatgatcttggacagctttctctttgaattcatttttagcttaatgtatttgttgtggcttctctaggaaatgtttgctgaattagcccctgtgcattgctagggctgataaggaatagtcaagagtttgagttcacaacaccctctttctatactcctgctagtccttcagtgtgaagtcccttagatttttatgacaactgggctgagatctttcactttacgtaacttagccaattcgcattgctcagtttttccacaataactagaatatttggcaaaagggcacaattttgcaatgggaaagctcccaaagtgaaaaacctagttgtttacccagttctgctaataataaatacccaagatgagacctgggacttctcctaggccctcttgcattgatgccaggtagaaggaggggtattagtgcagaatcagggtttgaatgacattcttctctgtggatattagagggataaactgtatggattgatagggaggtggttcagtatgttacaaatgaggacgttatagcctaataatatcactacatgctggagcaaataaagggccataaaacatgcagtgtgtacccagctagctcttccagaggccaagaactaaacttggaaaagggtgaaaggggcctgatctatgctcaggaattgaaatgtcatagcaagaaatatcagtacagaagagatctggaggttcacatgcttcagacagtttgatggaacttggtgatgaaggacgtgccggaatacagcaggtagaatcaaacacctggcctgtccattgatattgccaacttgaaagacagatatcccattggcttggtgatttgtttttaaagctgaaatgtgtgattgatcatcagtcaagcaccaattgaccaattgctaaaatatgaaaatggaaggaaatgtagaatgaatcactacttttgtcttctccagttgatctttgaaattattcagggtgataatcgcattttctgtaatattctatttcaaatattgtaaagtgggtcttggagtgttgggttcaaagtcagtctgttgtaggtaagacgtgtctggccatctggtagagatagggtccacggcacacatacctcacagtctggcctaggagcctccctgtacagttgattcagagttaaaccacaataagacaacaatagaagaggtggggggtaatacaagccagcatgccacacattgatgaatgatccggcgaggctttcaaagcaaggcgggattactctggttgcagtgggctggagaaggtaactgtacttagcagatattgcttttctatttgccagcccacactgtcaacagtggaaaacagtcattatcatatcccttctttgacgggaattgccacaaaatagttcacttggtaaaagcctgtctgaggtgaaccaggaacaaacggtgtgtatttaacatgtggtgtaaggttgcaccaacaataaaggaataaagttcaatttgaataaggcaagaggaaaccggatcaccgttgggttcatgtcagtggttgtttcacagtttctcaattctgaagccatgctgctgatagggacctagaatcaccaactaactccagtagaagtttaaaggacacttccatacggagcccctatagagagaggcgggcacttcatgcacccaacttttaagtatatacattcccacctgacaaagttagattttacagatgccgtggcaaatgtgcactcagtgctaacaaattaggatatcaggcctgtattaatgctttcattttccaattattttttattgcatttaacagctgacttcaaaagagctgaggacacacagaggaatagcgtgacccatcatcgcaatttgccagcgagtaggggatttcttaggatgtgggactttaagtgttaaaaaccagggcagtcagtggaaaatcaggattattggtcaccttacaaaggaatgacttggaggtaacatttttattaagtaagttttgcatttttggataatttttgaaccatctcatttaagaagaatgtggataaaatagcttccatgtcttcctgaggaggaacgctttgtgttgaggatggtgggtggtgggaagatggggaagcctccagtgggaggctagaggttgctttcagctccatttacttctcccaagggaaagctaaaggacaaggggagacaggcgattctataaccaaagccatttttcttgtgatttcttgctgtctaaactccatgaggctaaggctagagttacattgctaaactgtcccagagatcagatcacttggctcttttaatctttacttaaataatctttaattatttgctcttcatttttcctggaatgtcaacaaccctactttgtctccacctatggaaatcttgtgggctgcactcaattgttcccacctctggaaggctaccttcaaactcccaggtagagtaaattccccttcctgtgggcttctagaatattatggtcctataacacttatcacacaatatcatggttagctatttgtccatctttctgctgaactataatttactccagtttaggaactggagggtctttggaactcagcaaaaagaagacatctgatttagttactaatcaaactaaattgacatgataccaataacaaaggtttctattagtaacaagaaagccctgctaggattctcctggcattttgaggaaaagactatatgcataataaaatctcgtgcatcttaaatggaattccacattttagtgctgaaattcacgattttattttaattgggaaactgacaaagtggaggaggatgggaatattgagggattgaggagcaatgattaggggtagtaatagcacctgcaccatggattgcaaagcattctatcactcacaggattaaccatcatagccagtgctgctgggagtcttccccaagccctgtgaatgttctgcactgcttctgagagcccattcctgtgcttctctgtgtgtattaattttaacagcctgctgcccctaccaccatcttcataagattgcccttgggctatgggagccacttccatttccattgcagatgcaggaagccagagcccttgggaaattgcatgctcccatcaccctttctactctcagtcaaagactgatgggcagcatcatgaaagcccagctctcttacctaggatgctattttcactccagaactccctccccaggattaggcagggactgggtcttgtccttgtcctaaaattgtaccctggcttcttcccttcctgacttgctttccccacaccactttgggttcctcctgggagtactactttaataaattgcctgcgcatttttgtctcaacgtctatttccatataatctacctccagacaagattttaattttgtggcttcccaggacaagcttcttgctagaaagacccaaaggcaagtaggtcctcacctctggcctgtgaggtctggaaatgggtacacattatgctccaagactcacctatattccaaggaatcattttcaatgcctctaggataaggatggtgagaacaaactggagacagctggccatatcatgatgcacctgtggagggctctttaagctgctagattcatggaagattctgaggaagttttaagaactgttgtaagcttccataaatagctccatatctaacccaacttaaatagaatttattccaaggtaaaaatattttttccctctcatcacactttaaggttttttatgtcttgattcaagccaagatgaggattggaaacattatagcatttttttttcttttttggaaattattcttgggaaacagttctcttgaaaaatttggttcttgtgaactcttctgcccagtattcagatgtcatttcagatcttcatagaaaaatccagacttctatgtattttctatgcaaatttgacacaactaagagtctttccgttaactgtggaggtgggggttggggagcagaaagaagtaaacacaacttactgaatagtcatttatatttgtttttatcttcggctaaaaggtcagtaaaattaaccatgttcaattatgaaatgattagctatgttatttcatgtaatcttatacactagatttcccactttactccttagaaccagaattgtgaaacaaattttactcattggatgagagagagattgcatggcagaaaatattattttgtcaggattaacagtttgtcctatttcccttagttagtttcagaaatttccagaaatacttagatcattcagttgttaaagcatgcttaacaaagcctggcctctatgacagaagtcacatagacgcgcattttagaatttccccactcacctctcaaccctgcagtcatacatttataatgtctcatctcctttggtaaactgtcagatctgcagcctcaaaatctaattgttgacatatcaccaaatgaaaagtaacaaaaacaggtaaacatcaccaaaatgaagaacattgtcttagcatttaaactttaaaatgtatttctactactctggactcattttttccttccatcatctttaaaattgttataaatgagtatctgctccactgtgtatggtcctgcaagaactaaaacttcccagagtattaaactgtggttaaaattcatgcagtatgtaactcgatgctgagaagaagctacatatgcatatgtatgctcaaaatataagaatttaagaaaaatgtacgataatgaaaaatgcatggattgaaagtgaaaagagctgttttgagcttcaattcatcgctctgtagctgtgtgactttgcacaaatcacttatcttctttggcttccatctccttgcccttaaaatacaactaatcatgcctacattttgatctgagcatggacttaacaacatttctggcagtgttttacaaattgaaaaaaaggtgttcaaatgttagtttattaagtaaagcttaggctggaaatacagattaaatataaggagataattaaagttccacggtaacaaatcatgtcttccatatgtaatcttttgtcaacccacttgacaaatatgcatattttttgagggactatgatgtgccagatattgctggaaagatgtttggtgaataagacaggtaccattgagctctagactggaacacagatggtaaatggaaaagcttgagggcaacttcagacagtgataagtgagatacacaacaaaaggagtcttggggcacggacttggatcaggaccagatcagataaggacctcccagaggaggtgccattcaggctaggacctgaacaatgagtcagctcagtgaatgaaggccagaggggaccattccaggccgaggaaacagcccctgcaaatcatcccacctgagcagctggtatatactcagatcctttaattctcagttttccctctttcatcgttctgcacctctgtgcttacctgttttctatgggacttttagcatatcctcgcgggaggtctatctgattctagactccgggagtaccagctctaagaagtccaaatctcgtgtagcttcttcatcctcctgccctgaacccctgggagcccagtgtcttctttccagggccaccatttatactcccaggctgaaaaggagtcccttgcttccagggaaagaaagagcaaaagagaaggagactgaggcataccatctccactgggaaaacagaaatggaatgatttatgccctgagctttgagtcagcagggagaggggggagaaaataaggaagtctcagcccttccttcctaaagacagaatgacaccccatcccttccagctcccacttagttcaagcacccagaacagcagcagctgcacttggggtgaattgcagagcccagtactctggggagaggaagtatcattcatttccaacagaagcaaagtgttcctcaccctgtctgctctatgtcaaaccagatgccgtggtctggccccaccgacatgcctgggcaggggacgtgtgggtatatcatcgtctcccatgggaaacagaccgtttgcgtctcttggcattgcctttggaccagtgtagagggctctctctaggggaagtgcttttgaaaaacccattccatctcttaggattgaccacgatccccatgcagtctggccgtgagaaggccaggagagcacatgagccttggacgggcctcccttgatgtggtggctgcaagagtcactttgcataggatggacatataaccccattcccgaaagaagcttactgcctctgcttccagagatcttccattagaagccttcttcaaggatggaattctgaccatttctcataaagatgccagactatgcaagaatgctggaactcagattccaacatgtatcccgaagcccaatttccatgatccagaagaaccaaattttgcccatgtctattcagcttatatatatatatatatataatatttatcagggaaagcagggcaatagaaaaaaatcagctcaataaaggggttgagctaaaaacatgagttttcctctgtggcattttgcttaggtatgtttgacataggtatagtctgtatggattcattctgattccaccaggaggcaagagattttgttaatattcatttggggaggagagaggaaagagaaaaagaaaacatgggataaaggagagattgttagaaaaggtaatctggttatttatttatagtttacttagccaaagggaccttaaaatgctttgataagaatggccaaagtttcttcaaagattaactggcattctttaaaaaggcatcagttttcttttgcacaggtgtttggagagcccggactggatgcccactagaatcctgtgctggtttgtagatttccttaagaccttaagacatgctgacatcatggtctcctttctcagattccttctctctttttctctttctcccccactctctctctctgtctctcactttctctcctttcctccctccctccctccctccctccttccctatccctccctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggtaagaggtacacggcgcttatgttaactctggggcatgtggcacgctggaggtatttttgaaaaactttacttctaaaggtaatgaaagcgttgtgattcttttaaagcttatttaaatcatttaagacgcccgtgcttatctgggggaatttacaagtgctgtttgcatgtggaaaacgggattttacttaatgatgggacaaaaaaaagtgttttattcttgctcgtgaaacaatatccagatgtcgtcttgtttgcggtgggtgtacgggggtctagcttgcgggacaagaattactccgacttctctttgcaagggtctgtcagagcaagtttgttgattttcagcgattacatagttctttggctaattctgaagcagttactttcctttgtcaatggggaaatcagtttagattgccgtaaggcgaaacctcgccggaatattttaaaatctgttacctatccttttgagaaaagttatgtaagttttctgtggtaggtgtaaggaatgtaaacgatcctgagtttggaaatattatgaactttgttcatgacccatgattaatatgttttttaatctgtgtataatttcatgagagtttagactatcctcagctaataaatgttatactgggtgaaatttccacattgctcctgtaacgccaacgtttgtctcctctgtacttccgcatttagtcacttgaaggaaataagaatttattgttcaatagacatttcttgacctcataatttcttttaacccacaggttagaaaacttacaacgaatgtagtatttgactgtggaaaactaaagaccaaaaatgtgtaccattaattcaaatgtttagatttatctttttcccctttacctgtaagagggattttgaaaaaaaaaaaatccaagtgattcttaaaattcattttttgcaacctcaagatcacaagcacacactcacactcatgcacaatcaactgttatccccaatcctatcttcttttgtcctcttgtgaatgtttaaacaaatatgaaacaatcggtagtaatagccttaggtgacaaattctctcctatttaaaattgtcctaaaaatcaaaagaaaagtgtcccataaagctataatacatttttaaatatcatcattttgtgaaaactaaatacagtatcagagacacttccagccgattaattaggtaagtaagcacttacctcacacacagcttccccgggcgctgttctttcttcccataccttctagggttttactttttagcagtttttctccttctctgttaatataataagtgaccatccagggaatggcccagaggccacaaggcaagtcttcccaaaatactgaagattagaagagtttaaccaaattcctggtagcagcatgtcagaaacgctcatcaaataacggaacagacctttcttcactgaattaaataaatgtataaatagtctgggggttttacagaaattgccttagttgaactttgtgattctggttgcttaaggaaaacacatttttctaaaacgtcctctctccatgtttccactccttcctcccaccaacagttgtggtcattttacagaaagtcttatttccccaatttcctctcctcacacttctcaccagtgcagacagccagtgttttggggggaaagagagcgagaccccaggctgcacatgccagcaaacctgagaagccaacaaaagcaggtctctgggctctttcccataaggctcagcacaacctcactctgcttctgcatcgaggaaatctcgaaagggctgtgctttcttggggcgtgtgtgtgtgtgtgtgtgcgcgtgtgtgtggtgtgtgcaattatatacctgaataacaatgacatactcgttataagaaaactcaccaatatgtggctttaggcacggaatagagaggcaaagttattcggatttaatcagtacatgtcaaatctttggaatatcctttcctgtgcaatcccctctcatctgtttagagactcaaagcagcccacgaagttttttgcatactttgcctcagagtccaggattgcttatgaaatgtatttgtgtggtggatgcgtcagagtcttagagccaacataagagtccagagactgagctgtaagcatgataaagctgtcaatgactggcccgtgggaatgcttgttgaaggcatatacacctccctaatcattttcttcagtctttaatatgtaagtgatacagctaccgttatttttttccctgcagcaattcaagcattgcaccccggattaaatcatgtatctctaaatatgttgttttaattctttcaagtaaaaataattccacaccgaaaattgtcagaaagccattacatgagttaatattaacttttatgtctgcaaagatgagtttgttgcttattcatgggcaaatacaagaggcaagtcagacagaggttattgtctaccttctctctcttctgtcctttacctttatctcataaaagccacctcaggagtggggcttttggtgcagctgatggtgggataaggccggggaagtctggatctagaacaaagtgaaccaagggtgagccttattctatgcccctcaaggatgcagtgccctggaaggagacaggtctgactgaacacacctggctcaggtaacttcctggtgccagttttgcagacaggtgaaggagcagtgtgacccggtagtagctccagagacaagcaatctaagaagtgctaaatcttccctaaaagaacacaaggagcctgctcctacctttaaaaggagaactaagggcagagagggagagaaactaagttataatttataaataaaggtttataaacatttaggaaatgcaacttctttcttggatcctttatttataagttctgacttagtttctctccctctatgcccgtgattctccatttaagaagttttatttgctaaatattactctgttgaaatgaaagaaaaaaatgagggggtagatatttctgataaaaaggccaggcgagaaagttgaacttgacaggtgtagcctctggaacacgtctctggatgaattcagatgatagtagggggatctccactcatcgtaatgcagctggaatacacatagtgaattctgtcacatgcccagggagaatttcagtcagaaacatctgtgctgttttcacaagggaaaggtcagaactccatgagtagttcatgtgtctgcatttcttttgatgggcattgtgcctcaactagagaagagatcaataagccaatagccgccactatccaatttgaatccagaagttcacacaacctaattccagaatacagtttgtgcttctagatgaaaaattctaaagcacaagcacacaattccagatattttagccactatacaaagatgaatcagggtcacgtgatcatgctcacgtcagaagatgcaggagaaggacaaagttttgcattttggtacaaaacacgcatgtgccagccacccgattcgtttccagtagggagcagttgagtggaaggtcatgtctgcactaccttaggactgaggacctacagagggaacactggaaagaattagcaacagaataagccaggttctgtttgattctgtctctcccaccctgcagctccaattcagagcagtcttaatgtgcagggatccgcatagaaccagccaagcagggcctctcgtagtagcctgaccagaagtcacagaggctgtgtaggccactcattccctcattcagagttcagacatcctgagcctgcccatgtccctgagattacagataacacgaatcctcagagtcaccgctgggccatcaaagaaaaaagagggtgacgcagagagggaacactgcaggggaggaatgcaattcttagggtgctctgaggacccaggtgcctgggtttgggtttcattcacatcctgcttcagtcggagctgccctggtgttgggcggatggctatggaactcatgtgcattttctttagtgtctacactggaggctgatgaagattttatggacccttaagattgcacaatttgggggctttctttagagaaaacaaatgcaaaattaggactgtactattaagtacaaggatttggataggacctgggcaagtgaggaaccctgaagctgaagtttcattaacttcttgataaatccactctgtgtcatacatagtaaagccctgatacttgtctcttgaatgaatggttgaattaacttatgtaaattttagctgctggctgctctctcaataactctgaaaaatgataagcaaaaaatacctatcatgtttatccatatctagtgatcagtgatatatggaaaaccaatcttaatgctatctagaatgtttcttgtttcattggcaccttgccatgaaaggtaggtccttgtactgtagttgaacctttaggtcatatctcagctcaagggtaagatgctatcaaagctgcttttcctatggtagaatatgtgagtactgaaattaactgtgcgctttttccacctgaaaagcccccaacttaaaacctaaagaacgttatgctagttgtgccactagaccctagaatggtattgaatgcatgaataataagcatcttcctgagcagacttgagggcttgccccagtggaatatctgtgtctttggtgagaagccttcctcttttttccttagtttctattaacgctgtttccaattttcaatagcagttaattgtgtcatttcttggtagaaatgctggctaaacccatgcctaccaagccaaataatgttctcactcaatgatgtttacattttcaaatatttgcagattgatatcttgcttcatcttagacctctttgccaaaaaatacaaggtcagctccctgaatcttgctttcttatttcctgagttatccttcatgtctattccaacctttaaaggacaaatttgaaaagtttatcctctgctttgaaagtttatgaaatttgtcatcatttgtactcttcctaccaacgccattctcacatatctgctaggaggtaaagaaaatataatgaatcctggagcacctggctgctgtgactagcatgctctaaatactaagaaataagaaacctgccctgtcttttttatattgtcagaagtttgtggaaagaatttatatatggacagtgagctgtattacatacagacacaaacatacaagtgacaaaagcagtgtgggtgtgtatttagctaggacattaataacaaaactgactgtgtaggtatagagaggctatcccaatgtcaacaacatcagaatacaatggtactgtattttgaacgtcttgtttaatatatttcaaatctataattttgacttacagtcaaaattaaacattaagtgcacacaaaacaattaccctttaaacagtatttttaaaaagtgatgtcatagtgacattgacatctgacatctttttttttttttgagatggagtcttggtctgtcacccaggctggggtgcagtgatgtgatcttggttcactgcaacctccacctcccgggttcaaagattctcctgccttagtctcccaaatagctggaattacaggcacctgccaccacacctgcctaatttttgtattttcagtagagatggggtttcaccatgttggccaggctggtcttgaactcgtgacctcaggtgatcctcccacctcaacctcccaaagtgctgggattacaggcctgagctaccgtgcctggccgacattgatatcttaacgtcactccttaaaacgagttggatataatgtcaaacgacttgattcttgtcaacaggaatgctgtgataatctgattacggaagactcagggtcttggttcctaggccctagggacagaagaaggctagcttctcccagacaggccaaagctgctttgaggagggaaggggaggtgaagtctccactccattgccagcaggacacacctgcctaggaactgggggagaactctcagaggctgaccctatacttcctgtctctggagtcaggggacaggggtgattctgctggtcagaaggcaggagggagtgtcctgaaacacaattgaatttgacagcaaagcactgtctatcctgggaagttctgctggtgagcggagtcctgtgagggtcctggtaaccctatccctgcaagaaataagaaggtctgcactcaaataggttcagaaaacctttcctagtttaggcccctcttgaatcttcacagcaatcattaacattttaaaaaccccaagaagttctgcagcaaagacgttctttaactttgaatccaagttgtacatccattttggaccgcagaactgtccaccacctcctccctgaccacaactatgattccctcctctgactaacgtttcacacaaccccacgggggatgctttggccaactgtgatgggtgtggagtggcaaggcatcgtgcgatccaaagaacatgtgtgatgtccaggctccatttaggtgtaagttgtactactggggcctgactacctctgcatgtgactggccagccttcgggattgcgaagtggctgcttacagtcagccccaaagaatttttttttactttctttctgtttctttatgtccaccttattcctaaaagaatttaagtgaatttacaaagatacatacacacacacacacacaccatgaaataaaagaggaggaaaataagagtaaatgtcaaaaaggccatttgattaaatcatttacttacataaatttgaactatttttaaaaatcacagttgagtgcacacagatccacagtgccagaatcttacttttgagctcaacattaaatatagatcttaactacatctgaacttaacttagcttcctatttgaacctgggaatcaactgggcactcactgaatgtagttttacacgcactgtattttacaattcttttgaaagacaatgtccattttcctctgtggatcttttaaattttatttcaccttttacacccctttatgtataatttgtttatactgagattgtaaactttcttcattggcttagactcaggtctggcactagcctaagggactaatctctggtccatcaggcctgggctgggaaccctctgtgggattccctccccattcccggagatagctggttcgccctgcttggccccactttacaatggcctgcttacttgtcccttttccctacagggctgcaaactctttgacaatggagattttatgtagttatttctttgtgctttcagggcatggcccaaggtattcttcaagcaatatgtattgaatccacaggcactgacatgaaaggcataatttttgctataattacatctttactttcaccatgaacttacatctacctcatcctgcaaacgcacagcagagacctttttatctgaagtcttttgaaaatatgtgtatgtgaaaatggctaactggtgtgttctctcccttggtgaatattacaaagtgatagattggctgctagaattgcgtaagtggggttattaaggagggagacatcttattaaggagtgacaagaaacagggaaccatgtgcttaagatatagaagttgtgtaaacccaacagaggagaaatagaaaacatgcaggttattttggaaagaagaaaatgaagacacttgaaataaaacagaaaagtaaatacggagccagcagggttcagcatgggagtgtgggctggaagtctgattctgaggaagaaaacaaggggaaaaaataaaagaaagaatatactgcaatcccaggctagaaaggggtgatttgatccatggagcagcaaatgcagaaaacaacaaaattagcatcatttcagtctccttcaaacgctatgtctagatctggcttgtgttagcatacctgtggcaataaaggtatttggctctgaatgtgttttaaattttaaattgaagagaattttctaacatttacccattttaaagatgaaatattataggactaaaacttgtaagggccacttttctgtgattacaatcaagcgaatttcattgcagctgggagcagcctatgccagtatatggcatttcagagtctagggctgcataaggatatgtacatttaaacatgaattgtataattatggatattaacatgtctagtccaatatcctgggaatgttccctaaatgatactttctgcacagcactttgcttagttttcagtatctgaagaaatggtctgacttgctagccctgtggttggtagaaatgtatatttgatgggtttttaaatcaactctcactcagattttgaatagtcaggctttaaccctcagtgatcttcaccaagtatattcttgccaagggcttactctgcaggaggctgggtggtccgtcttatgtcgatttagaagatataagtgacatcaaggactcaaggagcctccaggctgctgctggacagaggtgtggataggaagacatggaggtagagaaacagtaaagaaaaacacccaaagcacaagaaaggctgcagtgtccagcagaatgtgatgacattgacatgagaggccctgacaaagttccagggaaagtcagagagggaaagaccagatccctttgggatgactgtaagaggcactgggacatttgagatgtgccttgcagaacaagacgacttccagggtcaggacggggagaagccttcagagcaggaggagttaccatgcaccagcaggagggtgcgggaggtcggcagtgtgcacaggggctgagcttactgcagggaaagaatgggagagtgagggccacagtcaggacaaagctggcagccaacagtgctgagcactcctgaaaggccaggcagggctctaagtatttctttttgtttgtttgtttgtttattatactttaagttctgggatacatgtgcagaatgtggaggtttgtcacataggtatacacgcgccatggtgatttgctgcacccatcaacccgtcatctacattaggtatttctcctaatgctctccctcctctagcttcccaccctgctgacagtacccagtgtgtgatgttcccctccctatgcccatgtattctcattgttcaattcccacttatgaatgagaatatgcggtgtttggttttctgttcttgtgttagtttgctgagaatgatggtttccagcttcatccatgtccctgcaaaggacatgaacttattttttttatggctgcatagtattccatggtgtatatgtgccacattttgtttatccagtctatcattgatgggcattagggttgattccagggcatttgtgttggttccaagtcgttgctattgtgaacagtgctgcaataagcatatgtgtgcatgtgtctttatagtagagtgatttataatcctttgggtatatacccagtaatgggattgctgggtcaaatggtatttctggttctagatccttccatggctctaagtatttcttaatcctcacacaggcaggctttcttgctaacctctttagagatgaggaaagcagggtgcagaggttaagtaacacgctgaggacacaggcttcagagaggggtgaagctggcctttgaagctaggttgtccatctctagaagccacacccttaagcctctgctgcaggaggtgggagttaaacataggcaatgagaagtcattgaatattttggttttctgggtcctgagctgcactttagaaataccagtctggcagtgatgatcaagtgactaattcaaagggtattttgagagactgagtgaaaggaatgaagacctggaccagcatggtggctgtgggaaggggcaggagagacaccggtgcaagggagattcagcaggtggaatctggggcttgcactgattggatacaggagtacagttgcttaaagagggagaggtgagagaatgaggacgccattgttaggaaacaaaaatcaggagatgtagctggatttagggagaataatatgccttcagttttggatgagtcagttctggactgctctcattccaggagatgttggaaacagagactggatccctgaggagatgctgttagtgagcattgattaacaccatgggactctgaataggcagtagggtaactcagaggatgccaagagagaatagaaagatataataaaggaggatgagcacaagaccttggggaatataattacaaaggatggggaagaagaaaaacccaccacgctgcaggagagtgaactctcagagaggcagatagatgagcaatgagtctgctgacccactggtaaccaacagtaggaactttctgaggaagacacagttaatggcgccacccttgactcatatatcagagaagaggagatggagggagttgaagggaagaaacagtggaataggaaggcttggtagcaccttgccaactcagttcagatgaaaagcctgagagaaactgagagattatcatttggctggcagagcagagttctcagggtcctggaagctggctgtcttcaagcctattaatggttaatgtttctcatgctcttttttgctaaatttgacaaacctattccccttcctcctcaaagtcaactgagttattcactcagttaaatctatcatgacttaaaaagtatatgcttagcttggagagggggttacatctgttcttgtagtcacataattactggagacatgaaggaagattccagcaactcaggcgccttctgaacaggttgaatacctggtttttatgagcaacccgcttcagttttctgagaagctctgagtaactacaactaaacaagtctattcttgaatatgtttataataaaaaaggaaagataatgcagttatttgctaattgctgcaatgattaaagcaagatgtttcaagtttatcctttcataagaccagcagccttttgaacacaaacaggatctgacaaagatagtaataatgaaagcgggagaacaaggaaacaatgccagttttcttcagaacaatcggttgccactgacttctaacctacctacagtttcaagtttctttggctgggactatattctggtttttcagtgctgtactgtgattaagccaaacttcagcaaaaaaggaagtgctgcattgtagcagtattgaaagttatgtaggtggattttttaaaaaaaatattacagcctaaattttcttagcaaaagtcaaatgagtaacaacacacagtttggaaacatttggagaggagaaaacaaatatctgacaagagtacttaaaatctgaaaaaaaaaaaaaaaaaaaaaaaaaaagaaagtgggaggagagtgagaaaaagcccctgacaggtaatggtggaaacctgacaaatggaaggtcattctaatgagagaggcggcctggtctcatggaaagagactttggcctttggaatctgaccttcctggatgtgaattccaggtgtgcagactcctggcagcaatactcttgggaaaggtgcactaatgttctgagcttcaatttcttagtacattatggggcatatgggaaagagacagaggtgggctacttctctctccactccaggatgccaccctcccactgttccccaccttccttcttccccaggaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggcagggaaattcctgccacaggacaacaaggaagttaaatgacatgattttttgtgaaagtgttgtggaaagcacttctgtcttctatcttatgaatcagtagggaatgagcattctcaaaatgaccagaatgattcctaatttcctttctaaggacctgattcccttttcatacgttctttttgttctaaaaacaaaacaaaacaaaacttactttgtaaagaaagcctgaattccagagccagagtctgtccgttaaaaactttcaagctttttttttaaacttataaaaggcgttataccctatagccactcaaacttgtataaacaagagttgcaatgtgaaaaaactcacttgctgggtttgcctctatgaacaactattgttgtcaatgcaaattgaatccgaaattacccttgtcattgtttttttctggggttgcttctttcatttctgttaaaaatacacagaaacattaaaaaagtaactatctcctctgttttataaggagaagaagggataaagaaaaagaaaatcaacttggcatgcaagtgagccttgctctggaatttgggtgggtctaggaaaaagcaccgacctcagtggaaaacatatatgggtgtgtgggaaatccctgtaaactataaattgactacacagtgcttaagctggtgtggagagaaaccacaatactctctgaaaccagagaggaggggacagagagcaagttttgcacgaggagagcacaaagtgtccctgggagacagagctgctggtaattcttagcaggcttaactggatctattgaaagtgaccactgtaaaacaccactgttgcaccctggggttctctgtgggatgcccctacttgtatcatgcaggaaccctatggcctgactctgcttcacccacacttcttcccaccgctccccagcaaggccccccgccctgttcaattgctcctgtatgcttccccacttcactgccattgcctttgcagctccaattcctggaaagcattctttcccttttctattagaatctcattatgtagcttcgaagcccttcaaggcctgtcaagactcagctttcccttcccgatggggccttacctcttctacactttctaaatgttatcttctccaggctgaacaaaacctagtgtgtctctttgctactaaggactaatcagatgctgtgtcctgattcattcggtgttggtgtatcccatatctccaatcagattacgagcccctggagggctgacagcacgttggacttggctgagctagaatcagctcccttttgcaccctgagctgagtgcatgcagctcagcatttgtaatcctagcctaatgcaatgtgaaatttattatctctctttttacaaatgaggaaactgaagatcagggagacagtgtgacttgtccaaagtcactagcccagttgcctttcagaaggcatctcactccatcttcaggatgaccccaggggctaggctttcacactttaactcctcctagaaggtcataacctgaagatctgagatttgaacccaagtctgtctggctcctaccctgtacctttcccactatagcatattgcctccctatcaccaaaatgcccaacacgaagttgaacatggcataatatcaaatgaacttgtgatcatcccgttttgtcaaaactaagagaacataaaaaaaaatcagcaaatttgaccagagcagtgtatttatggcaagaccaaggcaaaacttgattctgcattctttgcattatagtaacagactgaaaaggttcataagtgtattcatatttaagggagtgtgtaactgttctacctgggtcaatgtagaattccctatacgttgcatgcatcatcaggaatttcatatgcagcagataggcatacagcctggtttctccaacagccaaaggcatttctgagtggcaacaacactgatctggtgaagctgagtccatctggacattggggagccccaggccagcagggtttctgctaagtggacctttccaaatcctctcagggacaaaacctggttgggcatcttcaagaaaagatgctcttgtaaagttggtgtagctgcttaaataagccccgaatagagtctagtccgtctctctgtgcttttctttaaatttcccttcatagaaagctaaaacttaaagaggtttcagagaagctagtctgaccccatctcccagtatcattgagaaaactgaagctcggaggggctgggtcatttgccggaggttttgcaggacacagaagagcttgttctcctaatgtggcctagaactcttcaccaggcctcctcctatcccaggtggaaactaaagaggaaaagatgaagccaaactcaggcggaagcaacataattaaactggtttatcgtttggcaacagagatcagaggagtgagtggaaagtgaaaatcagtgaaacacttgcagtttaaaagaggcatgcgattcctgcttttcctaagcagttgaaatgtgtttatatgtctttcctggagctctctcattgctaatgtggtcctataaggggaagtcctggagactgagctgggtgtatttgagtattcttctcaatggaaggcaatgagcttgtgtgctacactgcttaggccacacgatcccccaagcctgggctgccagacgtcgccatcattgttccatgcagatcatgcccatcctgtgcagaaggtcactataggaacacatggcacagggaagaaaacgcccatagaaattcacatggtgcttgtctaaaccgaaggcaggtgagatccacccactgtcatgggaagctgctagcatgctcccatttgtttataataatttctccaccgttagaggctgctttaaaaagaaacggccaaaacctgcgatccggtgccacaattgagacagaaagcatgggaccatgacagttttaagaattactaaagtatgaggcttgaccagatcatttttccaaggatccagagccctttagagagaattcaagagggagaatttctggtgacttctaccacctctgaagaattaaaaaacttacttgtgctgctttccaggcctctgtggtagttaattctgcttggcagtttttgttgtcaaatagcttttaagaaatctggagctatctcagatataaataccttaatgatgccagaggactgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaaggtgaattctcatttcattcaaacaaagacagatttgcgcattcactcaagcagaatgtggccatgaatattcagcccctgcatacatacaaagatgtacgcatgattccccccaccaagcacacacacagtcacacacgcacacacacacacatgcacacacgcgcgtgcacacacgcacacatgcacacacacatacgcacacgtaaacacatgcacacatgcacacacgcgcacacatgcacacacgcacacacttgcacaggccctggctcttcaagcataatcatggtagtcatcagtgaaagacatttgaggttaagacagcaagtccttgacaaatatgttcatgtctatttggttctagttctataaaaatatgaacattgggactcagagaaaatggggaaaataaagtggattcaggttatcagtgaaatgatggtatagattacagcaaatctggatatatattgatgttactgcatttgcaaatgtcctcccattaaacagaaaatgtggctaaaatccctggcctggaactgaactagtttaaggcaggtgtaagaatagtgggaggaaagtttgtgaaagtttaaagaatgccctcaatccatgaacgagagggaggatgttgtctttaattatttagaaggtttttttttccttgtctgttgataattttatggaaggttgctttagatctccattccttaaaaaaatattacatgtcagtgtagttagatattatctcttttagttattatacttgctatttttactgtatagtgtggtataatcaacaaaaaataatgccacgggcatgtttacaccttttctgttgcactattaaattcttttcacagtattcatatcaatgctaatttgaatgtgatgccaattaaaaatcttgttcatttatattgtatatggtacaaggacgtagcataagatccaaaaaaaattttgtattgtcatttagcatatcaatttcagccaaatttggaagacttgatcatcttatcttttgctctacacactcaaaacaaatattgcagcagaaatatcaccttaaaaatatcttattttatatttagataatattgaaatcacagtctattaaaattggaaatttaattcaaataaaaatcaaacaaaatagttgtttcaatttatctaaatatctggtcttaagagtgccttaagagtgtctcgtttttaagagtgtcttaaaaaccaatatatgtataagtcaacaaatcatataatattcaataaatagctctgaagttgtatctgatttgaaacttaccattttcctggaaccttaactattattactttgtacgtaatactttcatgttactatgctaacaaaggatttaggtagccaacttaatttattatatctggtcggtcttctgcttgaaacagattcacactcaacacccaactaaggaggagccaaagtagtggagtattcctgacccaaaaaggcttttgaattttgaaacatttctaatgtgttaggttttctcaatgagaccattaaaaaacgttgtgttccatttgagaaaccagagtcaacagcagtaaatcagtgtgccccacaagccacgtcttattcagcaataaaatagtgctcacatggtgcctggcagacagtggctctggacagcaaagcactgagtcacccaaccccactcctttgggatggggttgggagtcatgcattggctccctttttcatcctggggaaattacaacacaacgcagagtgtccagaaatctaaagagctggtttaaggtgaaaaaaatgccatgaatgaatgaaccagatgtttaataaatcaaaacaactattttgttggatttttatttgaattaaatttcccaatttttaatagactgtgatttcaatattatcgaaatgtaaacaaagatatatttttaaggtggcatttctactccagcatgaaaaaaatagtggcatttgcactctagcattattctgtctcccttatttgagtcttcaatatatatgcccagctggagggagaagaagagaaaaatgaaagcactaggcctttgactaggtttggttctatatgctgtcatgatgttcaaaatgtcagacatttgaccacatggcacagtgaatactctcacgctctcaattttggctttcattcttgctagacttttcttctattaaatttctgaaataactagttttttttttttgaacttgaaaatcagctttttattttttttaattttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtgatgttccccttcctgtgtccatgtgttctcattgttcaatttccacctatgagtgagaacatgcggtgtttggttttctgtccttgagatagtttgctgagaatgatggtttccagtttcatccaataactagttttatcatagctttccatgatgtaattttttaagcgaaaggtactaacatttccagtcttgatttccaagttttgtggtgtgcactcgaaatctagtctctgattgttaaactctgggtaggtacaagaggctcttaattttcttcctcccaggaggacttacttacacttaaaggtcaaaagcttaacattcacttctaaatggttaactgcatacactttaccctttgtaaacttcaatttatctttttttttttttttttttttttttttttttgatactgggtctcgctctgtcgcccaggctgctagagtgcagtggcgcgatttcggctcactgcaagtccgcttccaggttcacgccattctctccctcagcctcccgagtagctgggactacaggcgctcgccaccatgcccggctaattttgtttttgtgtttttagtagagacggggtttcaccgtgttaaccaggatggtctcgatctcatgacctcgtgatctgcccgcctacaagccaggtgtggtggtgcgtgcctgtaatcccagctactcaggagactgaggcaggagattcgcttgaacccgggaggtggacgttgcagtgagctaagatcgcgccactgcactccagcctgggcaacaaaagtaaaactccgtctcaaaaaaaaaaaaaaaaagaaaaagaaaaagaaaagaaaagaaaataaacgtggcaaaactagaccttcagacacttcacttcacttaaccctatggccctccttatcttgcacccaatttcttttcaacatcatacatgcttggttgactgtttcttcatatttgctgttcattctataaagtcaaatagattggtgggttaaaaaataatcaattcaaattcaaattaggaatttatggacattcagatatccacatatttgagggcaggaatttttacttttcaattggtatgttggcagtgtgtaaaaatagaagaccaagagaaggcggttgattggagttgatacttaatagctaataaaaattacaagaaaggatggtggaagtcaaaggacagaactgatacacgagtataaaagccaacgatgtcatatatgtaggcaaagtctttgtaatctgaatataatgccagagagctagggctgccaggcactctgtatgtgcagaatatgtcctatatggagtaattttttatttgtgtagacttttttaggataccttaaatgtcttacatgcaacctttttttccccatatattacaaaattgccttggaaattagacaaatcttcaaacttaactgaaactcctgtcctgaatagttatttgccaaatctgacaaatttacaaagagtgttcacataatcccaaactatgcccatttctacaagagaaatacatgcctctttatttggagtttatgatattcatacaactagtagtagagtcagggagtattccagaaacatatttccctggcttgcccaattatcaagggaaaatttcagctgaacacggggaacccagtctttgacactcctgtgtgcagtgtggagcagcgtgcactgtctgagtctccatagtgaggaatggtcttccctggggcatcaccctagaaggatgggctcaaagtcgccctccacgtgggtgcacaggagcccagattctcaagccccagttgcagaattaggctgatggttttacaaaagagtcctcctaaaagtccatcactaagttttgtttggttagcaacccttgccacatgatgtagtacttagctataattttatttttattcaaggccaaatcttatctggtgtccatgccttcccacctacttaaaatttcaaatttcaccctcaaaaatatttcagtaaataaaagttagatctactcaaaattagactccaagggaattactatagttgattatagagtatctatttccttaaaaaaaaaaaaccataagttgttgactctgagctaggaaatgcgtgatctctcagctgacttactttatgcaaatttacttaatattatagaagagtaaagagcttccaagaaggtgattggagggaagttcaaagggaagatttttttcattcactgtagttttagctgtattctttcatctgcaatcaaatctcaggattaaggatgtcgtattacatcaaatcattacaggaagtatgactgtatcagcggctttttacaaaaacaaacctccagatcacaaaaggaagctgtgtttgtgtactgacacgaagtgttacgtagcagccaggagaggaaggatagcagccgacttggatccatttttgaggaattatttctgtaaggtgtcatggaattgtaagttacaaaaataaggcttttgtaaacagaatctccattccagaaggacggactccaaaatgctacttaatgaaattcatgggaatgttatggtgatggaaatcccaaatgacatgtagattttatatgcaaacaatcccactgcttgtaactcctggcagtgtgtacttaccaaaatcttgatcacacttaggtctcttgctatatatagaaccacatctgatccttatacagtgttgcaagatatatgtccttgctttcccatggttcttaagtgagtcttaagcttggatttgctccagcagaatggtggtttgtgtttctcaaggctgagctactatttggtgcatgtcggaaatctcacactaactgtggatactctgtcatcactgaacccaatcatacaatgaccagacagctttaaatacctacttttgtatgctatgaattcatccgtttacttgtcaaatcctttatttccatatgtgtctccatcaccttttttttctctccggataaatggaattactgtaacttgtgaaacaatggcaaacactataaagctaattttacagtcttgagtttctttttgtttcactggaatggtaatggtgttacagtggtgctctgacagacaaaaaatctaatatgtccttagaaagttcagaggggaacttatttgaaataaccttttccagtgatggcaatcacaataatgtgggaatgactaggtcctaaaaacttatcaaggtgttactgtatatcagtacgtaaagaaatgtattttgcttctttccaatcactgaatagaaaatgaaatccctgcctcatcgctcctttttttttttttttttaagacagagtctcactccatccctcaggctggagagcagtggctcactgcaatctccacctccaggattcaaatgattctcctgcctcagcctcccaagtagctgggattacaggtgtgtgccaccacgcccagctaatttttttatttttagtacagatagggtttcaccatgttggccaagtgggtctcaaactcctgacctcaagtgatctgcccgccttagcctcctgagtagctgtgattacaggcatgagccacggcgcccagcctcatctctctttttctgcctgatgctctcctgctccagaatgcttatttcattttagtcaatgattaaaaatcaagcaaccgtttaataacaaacatcctttcagcactgcaacccttaccaaagtgccttttgtgctattgctcctttacttggatggattaaaagaaagaaaacacttaactacataagtcctacaggcattagtatgggtgtcaccctaaagccgcacacctaattaaaacccacgtagccaaggagtgcatccaaatggcagtagttatcctccaagcagtttcctgggaaaactacacacacatgcaacaagatagttgccacagctctgaacattccagagtgtctctcttagagccctctcctttggagccttggctcattctttgtaacattctcaggggtggccaagctttgttcttggagggagcatgtgacagctggaaataaacaaggctgatgcagatagtaggaagtcatctttgaggatactgtttgaacaaaaaggcaaaatgttttctagaaagtgcacagtcatctgaaacacagtcatgaagctagccggtgggacacattttattaattttaatttgcatggaagttttcagacacatgttattttctaccccgttatctcaaacgtcaattgtccttccaggatgaccttggctgagaactgagctaaccacatccaagccataaggcagcattgctttcaccacaccatgtccttggagcagagaataagggaatttgtcatagcaacatgggaagctttggttctgggctggatacgcaacatcccggcaggcataatttcccttctcagaaatcctgtcttcataaatgttagacaaacaacttttatggtttaatttttcatgcaaaagtccatattcttcccagaaactcttacattgttcaagtgattatgttctaaattagtctattcctttactggaatttaacacttgcataataatcttagctgataaggtatttgagtgatctaaatgtgttttcacccgtcctaagggctgctttctgcatctttcttagtttgcctctattgagtctgccagaaactcttactctttttaagattttgttcacgtttttattttatttttttattttttgagacgaagtatccctcttgttgcccaggctggagtgcagtggcgcaatcccagctcaccgcaacctccgcctcttgggttcaagcaattctccagccacagcctcctaagtagctggtatcagaggctcccaccaccacacccagttaatttttgtatttttagtagagacggggtttcgccatgttggtgaggctggtctcgaacacctgacctcaggtgatatgcccacctcagcctcccaaagtgctgggattacaggtgtgagccaccatgcccagcccacacatatttttaattaacaaataataactatatatagttagggattacaatgtgatattttaatacacattttagaataattatatcaagctaatgatatatccatctcctcacgtattttcttttttgtagtgagagcatttaaaacccactctattagcagttgtactttctcttgacagtgtacctctctgtaaactctgtttaacgtgcccactcagcatgtgatttaaagatctgcaatgaataagtccactatgaccaacagactcacagcctcacagcagcccagaacagtgtgcttctccttacccctacccccacagtaagtctggctgacctgctacatgttcaaatatgttgtggcatgttctattgcccgcgtgcctcttctgctcatacaagccccacaccccccaaacacacaagtctcatgacatctggtcacatcttagatatccagagagcaagaaatattcatatttgtagggctctgaatgctaaaaacaacttcaaatattcaatagtccatgttataccccatgaaagggtagaggaaggacatatgcagttatctacactttgcagaagaccctgtagcccactgacatcacttccagagtggcccagtgagccattggtggcaatctgggtcttttccttcttttcttttctttttttttttgttgagacaggatctcactctgtcacctgggctggagtgcagtggcgtgatcacgggtcactgtaacaacttcccaggctcaagcaatcctcccgcttcatcctcctgagtaactgggactgcaggtgtgcgccacgatacccggataattttttaatttttttgtagagatgaggtctcagcttattgctcaggctgatggcgaactcctgagctcaagcgatcttcacaccttggcctcccaaagtgttgggattacaggtgtgagccactatgctcagtctggattttttccttctggcctagtgttttatctccaaaatttacaacatggaaatctcatggtggagcagatttccatgtgagatggatcaaaattagggcaaaagtgatagcagaatagataacccaggtgaaagcatgagactgggagtctggataaattgcctaaaggcctaacatgcttcaaaaggtctgttatttagaggctggcaacatgagataaatatcccgaaggtagagaagatatgaagtgatcaattgaaaaggaaaaggcagaggagtaagaatgccattcatcaagacagaaacagaatccacatccctgctgttcatctaagcagagacaaacggttgaccaaagactagacatggggtgactaagattaagaaatcctacagaaaagtcaagatgaacaagcattcagttctcaagtcctcacattcattatgattgcatcatatgaggctcagaaaagttgagtaatttgtccagttacccatctaccaaggcgtaaagccaggagtggccaacataaaagcctggcttcctctccatgttttgtcctgcctcccaggtgggccattacagggtgcatccaaaaaagcataggtgatttggtggttgatgctcttggagccaaagcagcatttgctttgtgctcaagtgtttccatcaagtgaaaacaaagccatggttgaattgcggtgtcaccacagacgacttgcgggcgttgaattcatgcaatgcaaataataagggattgtgccagtgtgcctcccattgtgaatagagcagtgagctttcaactgaatgttttgctgagttctaaaaacctgatttgtaaggatttatactgggcttctcagagaggctttagggtaggtaattattttaaggtcttggctgattgagtcaagcggcaaagagagctttgtagagacaagcaaacactgcagaatcagtgcagctggctggaatccgatactgagcttacagggcctaaagggagcaggtgagtggtcccagcacaagcagtcactgcaattacagtgaccaggcccggggaaggaaggctcaagacccagacaccaagaaaagctagaaacacagggcaagagaacaaggggtcttagaagctgactctagaaagatgttctgacagattgctcttggcactagggaagacctgcctacaaatctctccatttcacaagcagataaataaagaggggcaaataggagaggagtggagtatgaacccacaacacatgacggagatcaaggaagtagagcttcaggagcagagacccagacccagggccttcaaatcaagggcaggactctgtccttaataggagtcaggaagaagggaagcaagacaaaaatcctactgcagggacagaaaaatgaaggctggaactcaagtgcaaagaggctggccaacacaggaaaggaactgggtaaaatactggggcttcctcattggaaagaaggatttgtggcaagctggacctggacaaggtacacttgttaaggagtcaatggctcgtaacatcttcatctctcctcagtaggaatcagagccggaaaccacaatttctatttcagtgcttcccagggcaagaattggcagccagaaggcaagcacatcatcacagcctgaagtgcatatttcatcatcagatgaagcggtttctcgcatcatttattatttacccagtcactttaacaaccacctgatctctgagacaggtccgtggagtgttgtggtctccacattaatatttatttagcgatggacattgtactaggaaataaaagcagattcctaaaagagctatgttatttgtatttttcgagggctgccataataactgcaaacggtggtttagaacaattcattgtatcacatttctggaggtcaaaagtctgaaggaggaccatgctccctctgaggtattttcgctggtctctcccagcttctagtaggctcaggagctccttggtttgtaggagcataattctataattctaatctctgtcttcatgtgcacatggtgttctcacatcagcttccctttgtgcctgtctctgtgtccaaattgccccctttttataaggactccagtcatgttggattagggaccaccctaatgacctcattttaatttgactacctttctaaagatcctatttccaaataaggtcacattctgaggtactagggggttagggtttcaacatatctttttgggaggatacaattcaacccataacactattctttcccatccatttcatcaccaattgatctaccttcaaccttccttctaatcagaatcatactcatataaataaaccagaataagattctttgctttggaagagacagaagctttctctgggttactgtaactgtcctgaatttcctatttctgcagaatggacagaaaaagctgacttctagcagacattctattatagtttgaccatagccacatgggaagttatgccagtggacattcctttggagacagtttctggttcttagtgcagagagcaaagaacattcttccttggaaattgcctccactattttgtaaacaggagaggacttttcaaacctggttttcaaacagccagagactaattgtgccctctccaagttaatcatatactgggcttcctctctcaactgctctcacaaagcttgctgatttctcaatagcactgagatacttgaaaataattgatttctagatgcctttcataattctggctctgccattgtcgtcattttgtgtctcctactataaaggttagggaaaacccttgcttggcaagccagcaactcaggtatgttgcctcaaggtgattctgcatccatcactggaccaccagctgaggtccccacacttgctttgctttgctgagtcaagtcgcaccccattgttttgagaataatgctcttatgtgttgcatttctccccaaacctctcctcatccagtgccggaaacgtgagagctacccttgctttctcccactccctcatcacctgtatctaattcatcacaaatccccgtccacgctacccctggcattgctctcaagtcagtttcttctcttccattctaatctcccggtgcttagttctggccaccatcatcatcatcatcacaatatatgtttttaaaaaggcacatttcacactggctaccctgtttctagtctttctccttcccaatctattctccacactgtacccagtgtggtcattctaaaatagaagtccgatcatattactctttcactcaaaacccaacctccagataaagggcaagtgtccagacattggactcatgcctctccttgatcttgctcctggtaacctcctcccttgtcatctctttcccttgcgctctactttcaaacatcctgaactctttgcaatcccccagtgctgaaggtttttcctcctcctgcagcctctgggatattggttatgcttctcctttctgggatgctaccaccccaaccctggccaactcctgcttggtctgctggctgtctgtctgaatggctttcttgacagtgcctatgtgattctagaggaagggatcctgccactctgttgacttccccatggtgcacaggacctgatatgggatggggggcagggaagtgccgggcaaagaagagcagagtccctggtgagggctataccctctggcctgtgcccacggacctaaatgaggataggcatttctggttttgagttcaaaaagttgccttttggcctgccacaccccttcccccatcctatgcctataaaaatctaggactgtagcaggcacagacacaagtggctagacgttgagaggagcagaagaacacactggcaaacaccagcagacactggcaggccagtgacagtagaatgacatagacacgaagagaattcagtcaggggtggtcagagaagagtccagccgctggatggccagactccaggggaagatcgctttcccactccatcccccttctgactccccatccatctcgctgagagctacctccaccactcaataaaagcttgcactcatctaagcccacgtgtgatctgattcttccagtacagtagggcaagaacccgggatacagaaagccctctgtccttgtaatggggagttgtaaacactcacccctaggtactgccatggggttggaacccaaacatgctccccgcaacctctgcacctgctcatctgcatgctcccactatggggctgaacagtggggttccaaagaagcgagcaacacccctgttacatgccctgcaagggggataagggaacttctccggtttcacatccacctctcagaaggctgtcctgacatcatgacctagcctgccatgcctctgggtagcattccatctctggagccaggccttccaactgggctgctcccaggcccttgcccactctggtaagtggctccccactggttcttctgataagaccggggtgtggtgagtgagatagggagacacttgcctcagggacaatatttgtgggttgctgaaaaactcagtaatcaagattctattttaatggatcagtaagagtgcttaaaggaatatttatagtttcgggtgtttgagaagaaaaaaaaggtttcttctccagccttaaagagtcagaaaaagaagaataaattgaacccaaaatagaaggaagaaatcaaggaaataggaaatacactaacaagagttctgtttccagcaaaaaaaaattatcctcccacagataacaactataagtgctggaaaaatacataaaaccaactaaccaaggaccctagagagtgaaccaaagcaagcacacttcacaggagagttgaagttcacaggaagcagccagcatgggggaaattctcatttttttcagctttaccctaaggatagatgcagctggcttgtgtcagaggtcaactaaagctcctgtaaatagctcaccatttttctggctcatgaaaaaaaagagaaggtcccaagggcaatcagggctactggagggtggaagaaatccaagaaagaagagcacatgaaatgggaatccctaactttgtgcataaactctggacaagtcagtgggtgaccaccgaaccgtgcatagagagggcagactgcaccagtccaaactaagatcataaatactatgtaaccactggcaagaccaagcttgaagtttaactctaacaaagtttaactctaactagccctctaagtgaacatccacatactttgtaaaaagagaatggaattcagaatctctacaacatatctttgacaatgttcaggatacaattcaaaattaaaagacctatgaagaaccaggaaaatgtggcttactctcaagagaaaaggtagtcaagagagcctaaccctggggtgatcctgatgttggaattattacataaaggttgtaaaatagctgttaaaactatgctcagtgatttaaagaaaatatgcaataaatgaaaacttaagaaatctcactaaatacatagaaacatgaaaagaaccaaattaaaattttagaactggaaaataaaatacttgaaataaaacttttactggatgaactgaacagcataatggaggtgaaagaggaaaggataggtaagttttaatataaatcaatagaattatccaaactaaagacaagaaagaaaaaaagactaaaaaaagtttgtcaaacaccaggaatctgcggtataatgttaaatgtactggcaaaaaaatcccagaaagagaatggggcagaaaaaaatatttgcaaaataatgacagaaaataaccctcatttggtgaaagagaaagatgcacagattccagaaactcagaggaccccaaacaggagatgttgtattatatcaatatatatagattatatatgcagaagaccattttaaaaataatcaaatcaaactgctacaaaccaacaataaagagaaacctttgaagagagcaagaaaaaaattctacattacatgcaggagaacaatgattctaatgatcacagaatctgaaaagagaccatggggtgtagaagatagtagaacaatattttaaaatgttaaggggaaaaaaaaacttgtcaatttagattctatttccagatatatatgtttgtttccagatatatatatatatgaaatatatatatatttctatatatatttcatatattcttctgaaatatatatatatatatttcaagaatgaagacaaaatgaagacattttccaaataacagaaaactaagaaaaattgtctctacagacccacagcacaaaaaatattaaaggaagattttcaggctgaagggaaataaaatgtcagatggtaactttcatcttcaagcaggaagaaaaagcgtcagaaatggtaaatatctagggaaaaacctgttttctcttaatttatttaaaacacatatggatatatttataattctaaaagtatcttgtggattatacatctatatgtatgtggattatacatatatgtatgtatacacacataatagcataaagacagtggggtagtgaatggatatacacacttgtaagattcttacattcatataaaatgatacagtttaactcgaactagactgaaaagttaagaatgagcatgggatcttcagagaaaaccactagaactgataaattagtttaataaagtcacatggtaaaagattattataatcaattgtatttttaaataccagcagcacaaatttggaaaataaaagctaaaaatttatttatgatagcttcaaaaataaaatatttaggaatatatttgacaagatatatctacaacttacaactgaaaaatacacaacattacagagagaaactaaagagcacctaaatacatggagagataaaccatgctcataggttggaagactcaatgtggttaaaatgtcaatttccccaaattgattaatagatttattacaatcccaaccaaaatttcaaccagctgttttggagaaattatcaaacagattctaaaatggatgtcacaatacaaaagactcagaatagcctaagattttttttaaaagaatcattttagaggatttgtactaattatgtcaacatttattgtgaaggtgtagtaatcaagatggtatgtaattacaaaagggtagacatttatcaatggatcagaatagagtccagaagtagacctacacatataatgccaattgaattttggtgaacatgcctgaaaaaaattcaatggggaaaggagagcctttccagcaatggtgctagaataaccaaatcttcatacggaagaaaaaaacactacagagaacctcacatcacacacaaattttaaaagggattgtagacctaaatgtataagctagaaatacaaaacttcaattatgttttgttattaggtataagctagaagtacaaaacttcttgggaaaacatacaaacacatttttgtgactttggggtaggcaaacatttcttaaacaggacgtaactagtataaacaaggagaaagatgatcattggattttatcaaaattttttaaaatttcctaagggaaacaattaagctaataaacacaaaccacaacattcggcaaaactatatatatatatgacaaagcacttgtatccagaatatataaagaagtcctgcaactgaataagaagacaaaaaagtcaattaaattgtaggctgaagacttttttttttttttttctgagacggagtcttgctctgtcgcccaggctggagtgcagtggcgccatctcggctcactgcaagctccgcctcccgggttcacgccattctcctgcctcagcctcccgagtagctgggactacagacgcccgccaccatgcccggcttattttttgtatttttagtagagacagggtttcaccgtgttagccaagatggccttgatctccattggcagaagatttgaacagattcttcacaaaaagaagatatatgaatggccaataaacatatgaatacattattctacatgattcgttgtagaaatgcaaattaaaaccacaatgagatgtcacgataaatccatgaacagaaaataaaaagactagcccaattgttaatgggtacatggagcaaacggaactctcgtatactgctaaacagaatacaaaatagcacaaccactaaggaagactgacaatttcttaaaaagttaaacacacatattgtaagactcagacattccattcttaagcactacccaagtgaaaagagaacatctgtccactcaaggacttggttgggcagtcatcccttggcatctgaaggggattggttccaggatctccttcagataccaaaatccaaggatactcaaattccttatatcaaattgtataacatttgcatataacctacatctattctcttatataccatctctagattatttataatcataatacaatgtaaatgctatgtaaatagttgtttactatatttgattttgaaacctattatttttattgttgtattctagtttgtattgttttgctatttatatttttgatccatggttggttgaacccacagacacagagggccaactgtacaatattgttcatggaagccttcttcataatagccaaaatatctgtaaaccacctaaatatttatctattggtggccgggcacggtggctcatgcctgtaatcccagaactttgggaggccaaggtgggcagatcatgaggtaaggagttcaagaacagcctgaccaacacggtgaaaccccatctctactaaaaatacaaaaaaaacagccgggcatagtggcgagcatctgtaatcccagctactggggaggctgaggcaggaaaaatgcttgaatccgggaagcagaggttgcggtgagccgagatcgcgccactgcactccaacctgggggacacagcaagactctgtctcaaaaaaaaaaaaaaaaaaaaaaatatatatatatatatatatatatacacacacacatacatctatcaatcggtaaatggataaaaaaatatggtctgcccatacaatggaatacaagaaaaatcaatgatctactgatgagaaaaacaatatgatgaacatcaaagccattctgctgagcaaaatgagccagaagtacatactgtatgatttcatgcacagaaagttaatcagaagttgcttggggtcaggagtggagggagaaatggactgaaaggaccttgagcaaactctgggagcaatgaaaatgttctgaatcttagttgcaacgacgattcacaggtttatacatcactcaaagcacatcaaccaggacagtttaaatagatctttatcttacttttaccacaataaattggattttaaaattaatgtgcatgctaatcactagggagctagttgaaatggaattctgatccattagatttgggagtttcctaagtttccacatgtattacaagctgccaagtgatacccatgctgatggtctgagttccacacttaagagaagcttcagactacgattattcaatccccaaatgatgaagccgaggagcattttatgaattctcttctcgggtgtgattaacattacctctctcatgcttttagagctgtgtcatgtcccggaacttcccctgacgcgacattaatactctgtgaggttgctaataacaatcacatctggcatttacaaagcacacactaagtgttgggtaccgttcttacagctgtacatgaatttacacatttaatccttgatacaaaagcaggtactattactatctcatattgacaaatgtcaaaacaaaagcccagaaagtttatgggacttgcccaaggtcacccagctgatgagcagatgaggtggattcaaacctaagcatcccaaactcttaagcactgtgctctgtggcttctccttggaggaattataatcctctgagtgaggaaatcttcctgctttgccacactttatggagggctttactggttcaacatcaaacattgttgattgagcacttgccatgtgtcagggatttacccaggagttggtggtctgctctgtgcatacttccctgaaaacacatataatcctttgcctactaacccagcattggcagtgcccactctgtgggttgtttgccaagaatgctgactgtcattactttgccacctccctccattctcccactgggggagtcacaggtgagcagaagcagcctcatacgtttccctagtgtcagagccagagctatgagacaaccaggctatgagcatctagggttttgttgtgcttttgtgatctctgactatcagaaatatggagcgttgttcagatatccctgcaactcgaggaaattcatttaaactaaagcatgacagctgtcagtgagatgaaaggtagagctgaatctggagctccttcgtgcaggcctgtcgtattattccattctcatgctgctataaagaattacctgagactgggtaatttataaagaaaagaagtttaattggctcacagttctgcaggctggacaggtagcatggctgggaggcctcaggaaaatttcaatcatggcagaaggtgaaggggaagtaggcacgtcctacatggctggagcaggaggaagagatcgaaaagagaagggctacactcttttaaacaaccaggtctagtgagaactcactcgctatcatgagaacagcaagggggaaacctgcccctgtgatccagtcactcccaccaggcctctcctccaacactggggattacaattccacacgagatttgggcaaggacaggaatccaaaccatatcacctgtcaacatttccatctccttgaccaagtgggagtgagagactcctgacccctctcctggaataaggataacataacccagggcttcagagttgtgagctccatgtgctagcttgttgcagcaagtcttgcagaagttgagtgatggggacagagacccagcaaaggctctcctaggagagctgcatgatgcattaacagtgtccactacagtacaggagcctttcaggagagatataaggaggagtttcctgagcaggaaagttgttgatcacaagaacaggtgagcaatgaagacaaaactaaactggagtcacaacaactcggatataaatccaccctgaggcaggggactggacccattgagctgccagagcccttatatatctataagttgacttcagagagtttcaaatccgataggactttgcaagtaccatatcgaagataaagaagctgatccaagggaacgttggccaagcccacttcgcagttgagaacaacatggcttaaaaacagcctgcacagcttcctggacgtcccatcacatttgccaaatagcattttggtgagctgagaatcaatgaatgagaaacagatggatttaatgtcccttgaaattagggatgggtgagcccagccacactgtggaattgctgaatgtctcaaactatttttttcaagtatctttggttcagaaaaaccaaaaccatggttttgcaaagcacgtttcctctcattcatatgagggttcgtgtattttaacggaaatttgatctgcatatttcaacttctttacacttcacttatcaaaatgctaaataaaatttccaggaagtctgagaaatatttataacttttttttccaaactattttatttaggaaaggaaacaatggggaagtttggaaaatcctacaaaagagaaggtgggttcaggtggaagttcacacttttagggagttctatgtcccagaattacgcacatgttaggtgtgcagtcacaatgtgctcaacgagtatatttgaaaatctcttgaaaagtgaggggaaaggtgggaaagttcaataaggacaagcttgaggaaaggctgaaaaatacaacataatttaaaatagcttctcatctctaatagccaggcagtgtattcctagcagccataaatctaatgacgcagaactatagcattcttgtatcatccaccagcatgaactccaccattcttcagatgtcttttctctttataagacttgtgataaaggtgcttataggatgctcatgagtggagggatggcaagaggagagggtggaagaaatgcaccacagagggtgggtgggagcaggcggtggagtgagtgcccagcgccatctttgttttagagaatgactctgaccacagacttatgtgtgagccctgaagagctgtttctacttaaagcttagctttcggttccagaggaccaagtaagacacaagcgggagagacgcagtcatcccatctctcagggagctcagtctgtttgtattgtgctggaagcacagtgcttgctcatcaccgacaggcagacttctgctcatagtgtcattggcagagagtgcagcaatggacactgcccaaaaggagagaagaaggaaaaggcaactccttgtggtatctgattacgtttgtctcaaatgcccaggagacattccctggggattcccagaaaagcaatttaagatggggatttgacagggagcaataataattattgatacaatctgaagaataatgtttattacgatgaatatgcttctcatttaaatccccaggctggtgcaggaagcacaaacatggattacatatctctttaaagccatgtattttctggcttttaaattagaaaacccaagtagggttgtgtggcagtgacaataggagttgtcaaatattcctgggactcccccacatttcccagcagccttccaggtagttaggttggtggcagtgattgatctgggccaacagggtgtgggcatgaatgatgtgtggcattttctgaccaagatagtcaattcttccattcctccctcccctcctcagagatcttggtctacaatttgcccagatgttttagctaaactggacttctcacaaaggagaactgagcttttactctgtaaaaccactgtgatttggcgggggcgagggtggggggtcttgtttgttacagtggctagtgttaactagcctgattaacacaagcgttaactagactaatacaggttgtaaacttacaacctgtcattatgataccctgatagtaataaagctggtggtttggggtaagattctcagaagtttttgagaatatagtagtgccttatattagtaatctactgctatattaaaaactaccttaagaggtagtagtttaaaacaacaagcatttattatctcaaagtttttgacggtcaggaattttggagtggcttaggtaggtggctctgactcaaagtgtttcatgaagtgcagtcaaaatgctggcaggagctgcagttatccaaaggcttgattggggctggagaatgcattgctcatataggagccctcaatttattgctggtttctggctggagttctcatttcctcatcagatgctcctctttgtaacgattctcaggcaagggaagctagcatcattcagacagagtaatccaagagagaaagcaaacaggaaaccacagaatcttttattgcctagtatctcatgttgcttcctcccccacctattcattaacagtaagtcactcagtctagccacactcaagaagaggagaataggttacagcttttcaagagggtttcaaagaatttgtgaacagattttaaactaccccagagtgggtacaccccattaccccagagtgggtttgtaggtagctaagggggtagaatggtgggtggcacctaaggtggggggttcagtgacccaacataaatcaggctaatagagtgtaatggtgtgactgctcctatcttacattattccttaatcgcaacagcggatgaagggaacccagccaattctattcaagcagcctggactgggcccctgacaagcatctgcatatggagatgccaaggtaatttgagatggggattttctacagggagcacagagaaattcctggttgcttacctctgtgcatagacatgatgcagaggaaatgaactctcatgaaacaggacattgtgccgtaaccaggcttgccctggctgtatagggaggtgagttccggcattgtcctctgacatagccccctcctcccaacctcccagcttgcctggcgctacatagtgtgctaattgctgatagaaaccctgggagtttgcagaggaggataagatagatcctacagaaagagaaattcttccctttgcataaaacctgtgcaaatgaagctgatcttgatcttagcccatggcagggaatggcagtaacactggaaatattggctttgtgaaggctggaatttttcatctttcctcctatattcatagtgcctatataagtgtgcactaaataaaaagcaccttgctggtattttttaattaattgaatgagctagcatttaccatggaagaaggtgtggtggcataagagggtgacaggagttctaggtctcataggttcctgatgccagaaaattcaccagcccagccatactgatggcagccttgcaccctgaggaaatggttgtgtgagttcctatgaaacaataacattgggatctaatccaattatgatatgacccactcttggctgagcccaaagtgggatctgcaccatggggcagggaaaggaccagagataaaggctcagtttatgccactccttctcaggctgatggtgtttacttgcatagccataaaaagcagccactggggacagtgggagagtgtggtaaagctggacatattgcattagcttgctaatcactattagcagcagtgagaatgggacatttccttagactccccggatttggacagcaacagcaggttctggggccacagtggtggtacaacagagctcccctgagccgccagtgtccagaatgtgaagtcctctagcctagggggaacatagcttctcctactaggaactgataaggaggagccacagctcagcaatgggaagggtagacttctttctcatcttggcatgggcttccctggttgaaacaccagctggtgaagcatgacatactggtttgagttagttttattttatctttaagaggacttttaactggaccatcacccccaggaaatgtttcatgtaaagaatagccaagaaggccatagattccatcccaccaatgacacacagcaactgaccattcacccccatatcctgcactggattttccatatggccaactcaagtacacatattgctttaccaagtgatgctcatctttgcctgcaattaccaccgtgattacatttctcctcattagcctagatgggagggtgcagggaaggatggttggatcaggagatctagttaccatactccgacgctgaatttgctgggtggctctgctcaagtcagttgacccatctgtgcctcctctcgtggcccttgttcagatatgcagtgattccatgactgattttcagtgttggtctcaagcatgtagctgccacttggtgcagagcattagcatatctttgtaattgctaatgagggaaacaaaattccagaaaagctgtttggaggaacctaagaataacactatgagctaagcattctgcccaaacaaattttgttaaaagaaaaccaaattattatccttttgcaaaataatagcaataatggccttaactaacatttgccaggctctaaatatgtatcttgcggtgtctaaatattttacacattgttttcattccctcctgttcaccccattggtgagggagacattccacactagaattatgaggatgaccaaacacattacactcgatgcttaacagatgcgattgacggcagttattattcacatacactcgcagcttgggagaggtgaacacagcatgggatgctggccatacaggggttgccctcaggagcagggtgaacaggcaggggctgtgggtggcaagctttgtagcaacaagagggtgaggtgctccctggttcctgcaggagaatgtgatgggctttgaacaattccgaggttagcaggaaactgatacccactactcagggataagtaggagctgtgcctggtccacttgataaggtgggttgcttgactggagccttatctgcaagagtagaatggagagaggctcttgtgggtaggtcagtagaggtactgctgatttgaccagatttgaaggcagcacactataccacgcctcaatttcagcctttacatgacacacacatcgtattatttcatcatcgcaacactcctatgaaatatcattaagcctttttacagatcatgaaattgaggcttaaatgaggccaagcaaattgcccagtgtttgctagctggcaagtggctgagctggtattcaaagccaggtttgttactctcagagtctgacctcataagcaactgtggacaggtagatgtaacaacccatcttagacatgaatcaagaaaaaagaaggacaaggggggaacaccctaccccaaataaccagagagctcaacttaaacacacacagtcttttgttctgtccaccatgtgacctcctgagtcccaccgctaccttccgcaaggcagctgggttaataaagccacctcagtgaccattaacagcagcagctctgcctcacactttaatcagtggtccctgaagtgcttacaagcccagctgctcgggacacacttttgattctacagcctggaggaagagaaaccatccaagcagatcaaccatttcccaggtgcttcaaattcccaaggtcagagacggcaccagtcagtcatccttttgcatgtggatgttgggtatgtcaaagggacttgatgttctggaataaattcctttacacagaaaagaggctttagatctctttcagtccaaaaccttcattttatggttaaagaaagtaaagtggcctccccaaggtcacaaagttggttagggcagaacctgcttggatcccttccctaaaccctttcccaacttcctcctcccatgcacacctcccactctcaagtggaagaaaggagaaactctcttcctcagcaccctttgcagttaggctgaccatgtgacccgttccaggctttgtgccaagagggaatctgccaggaggagtctgggagcagtgtttcctccctgatagaaagaaagaatggccgggcgcggtggctcacgcctgtaatcccagcactttgggaggccaaggcgggcggatcaccaggtcagaagattgagaccatcctggctaacatggtgaaaccccatctctactaaaaatataaaaaaattcgctgggtgtggtggcaggcacctgttgtcccagctactcgggaggctgaggcaggagaatggtgtgaacccaggaggcagagcttgcagtgagcagagatcacgccactacactccagcctgggcgagagagcgagactccgtctcaaaaaaaaaataaaataagataaaaataaaataaataaataaataaataaaatttaaaaaaaagaaagaaagaaagaaagaaagcatggcgaaagagctctctcaccatcctctccaacctctacctcctataagagccagtgaaggacctgaggcttgaaaccagaggtgtcttttagccatgagggaaagttcagagatgcggacacagcaactcagcctcatgtggctgctaaatcaacccccaaactgcccttcctgactcctcatttcagtaacaattaatccaagtttaaaccactgttagtcatgttttctctttgcagccaaacaccctcctctgagcagcagtcactagagttaggcagtgggtgaatacccagaaatgtcactcactagcaaccagacccagggcaagaaacttttctctgtctcagtttccttttttggaaaatgggcatatatttttacagaggtgctgtaaagtagtgctccccaacctttttggaaccagggactggtttcgtggaagacaattttcccatggaccaggggtgtgggggtgggggaaggtttcaggatgactcaagtgcattacttttattgttcactttattcctattattacattgtaatatataatgaaataattatacaactcaccaaaatgtagaatcagtgggagccctgagcttgttttcctacaactagtcagtcacacctgggggtgatgggagacagtgacagatcctaaggcataagattctcataagcagcatgcaacctagaccccttccatgtgcagttctaaatagagtttgctatgagaatctaatgccgccactgatttgacagcaggtggagctcaggcagtaatgtgagcaagggggtgggggacgactgtaaatagagataaagcttccctcgctcacccatcattcacctcctcctgtgtggcccggttactaagagtccaggactggtacccatctgtggcccggcaggggggagtggttggggacccctgctgtaaagcttaaatatttataaagattgtataatattttctagctcacaattgactgttagctattattatttcattattctctcagcctactttcacagaggctctccaacacagagctcctcaaaacttttgacaatacagatgaattacctggcaattgtgtttaaattcaatttctgattcaaaaagtctgccgtgggcctaagactgcatttatgaaatcttttagggtatgtctgtgctgctggtgctcagatcacactttgagaagcaagactgtgggaccctctgggtctgtttcctgctagttcagccttctagctggtggatttgcactaatagtatgccccaaccttctcgttatactcatggaagctctttcctacagtcagactgtccttacatccagcagcatattcatgaaattctaattcctgggcttagccagtgactcagaccctccttctccaggtctaatggatgtcactgtcaatcacaatgtcaccctcaaaggcccacggtctagcctagtcagagggaactggatgtacagaaagacaggtatatggaagaaatctggggctttttgaggatttcattcaaagcaggatgcaaaggttcatatacttcaggactggagccacttgggggccttggtctcaggatgatgtatgttatgataacccccaggactagaatccattaattcccttgatccagcactgtgctccagccctgggacaggcttaaagtttgtcctgacccagttcatctcatctgcctgcctgtacttctgtcagctgcctgtgccagatgttttattcccctccttccacttgtgaagaagctcaaaacctgcgatgagctctacttccttccaaggccagtcttgccttcacatacctcttccccttcttctccctgtactctctccactgggtctccccacactcttgccccccagtcctgtgctttgctctccatgttgctgaagttcacgttctttccttccagattgtaccctcaattcctctcaatcgattttgtgttgcgtgactaccatacagtaggtaattcataaagaaaagatatttataaaatttattctcacagctctgaagtctaggaagtccaatgtcaaggtgctggcatctggtgagtgccttcatgctgtgtcatccccaggcagaggacaagagagcaaaagagaaggagatggccaaacttgcttttataacaaacccactctcatgataactaacctactcctgcaataatgacattattctattcatgatggtgaagccttcatggcttaatcacctcttaatggtcccacctcttaataccatcacaatggccattacatttcaacacaagttttggaagtgcagtgttttgattatttgtccccttcaaaaagtatgttgaaaagtctcaatgtagcagtattaataggtggggcctttaagaggtcagtgagtcatgcgggttctgccttcatgagattaatccatacatgaattaatggattaatgggctatcacaggaatgagtctgtttaaaagccagcgtggctctcattttcacacccttgccatgtgatgtcttgagccatactgggattctccagagagtccccaccagcaagaaggccttcgccagatgtggccactcaaccttggatttcctcagaactgtaagaaatgaatttattttctttataaattatccagtctcagttattcaattttagcaacagaaaacagagtaaggcaggagggggacattcaaaccacagcattccaaccacggcccccccaaaactaatgtttttctgacatacaaaatgcattcattctatcttgatgccccagaagtcttaactcatttcagcatcaactcaaaagtccaaagcccagagtcccatctgaattagaaatcggggagactcaaggcatgattcatgctgaggcaaattcctctccagctataaactgtgaaattaacaagctacatgcttccaaaatacaatggtgggacagacataagatagacattcccattccaaaagggaagaataagcaagaagaaagagataatctgctttgactccatgtcctgggcactctggggcaggagttgggttcccaggaactcaggcatccttgctcctatggctttgctgagttcagtctacctagcaggtctcacgggttggagtgtggcaccagcagctctcccaggttaatatttcaagctggtagctctacagttctggggtctcagaaatgaccctggctccgctaggcacagcacagcccctgcagcagctccaactccacatttagactcagcattgcccgaatagagctccctgtgatggctctgcctccatgacaagtctttgcctgggcccccaggtagactgtgacagcctttaaaatctaggtggaggtcactgtgccccacagctcttgcattctacatgcctgcagaattagcaccatgtagatgctgccaatgtctacagcttacaccttttggagcagtagattgagccacaactggggccacttgaaccacagctggagcagtggagaatcactgcaccaggatgtaaaaacagagacccaatgtggccctggacagtgagcctgtagagggcatccaggcccatccccaaaaaccattctgtcctctgagagctctggacctgtcattgagggcagctttgaagatctctgaaatgcctttggggtcattcttccactgtcttgatgagcccttccatctgtacgagtctccttacccaacggtttgttggccacacccttggtttcctcatgtgaacacattttcattctgtaaatggtcaggctgaaaatttaaaaaatttttctgttctgcttttgttttaaattataaattccatctttaagtcatttttcccctcttggatcttactatatgcagttaaaagtagctgcacaactcctccaatattttgcttagaagtttcttctactggatattctagtcgggcactcttaaattccaccttctgtaaatcccttgagcatggacacaatttgaccacgctctttgccatttcataacaaggatgctctttactccagtgtccaaaaagataccctctttttccacctgagacctcatcagaatggcctttacactcagcatttctaacaacattctgatcatggccactcaagtaatctgtaagaagtttcatactctccctacagctctcctcttcttctgagccctctccaaaattgtccttactactctgtttatggaaatgtaggctttttctagcctactcttccaaattttttcaacctctatcgattgcccagttccaaagctactttcacattttcaggtatttgttatagtaacagcctcaattctcagtaccaactttctaaccattttgtgtttctataaacacaggttgggtaatttataaagaaaagaaatatatgctcacagttctgaaggctgggaagtccaatatcaagatgctggcatctggtaagggcctttgtggtgtgtcacccccatggcagaaggtggaaggcaagacagcatgagagagcaagagagcaagagggggtcaaattcactagtacaagcagcctactctcataaaactaacccactccggcagtaacaacattattcaattcttgagggtggagccctcgtggcctcatcacctctaaatactgtcacactggcaattaaattttaacatgaattttggaggggacattcaaaccacagcactctccaaacctctcttagcatcttctataagcctctagtttacaatatgccaaatgccactatggccccttgtttgaaacatgtttgtctccccagtcactgagctttctgaaggcagcaacagcctttcatcccagatcctctttctggctggacccctcccctggctccaccccaacctaacatgccttccaggcacctgtgtcactctggaggcggaagagcacaggcaattacctgtgtgatgtgtttttccatctttgtttcattgccttcatcaaccttctgatcaaggtagccagaagctgctgtatgatcaagtgaaaaaataaaatctcagaattattaatcacttctaatgtgctgggcaccctgataagaaatttatgtatgccagtttaattaattcttgcaactattatcgctattggatttctatcatctccactttacagatgcggaaatggaagctgagggcaggtaataggaatattgcctgaggttccacagccaggaagagaagcagtggagccaggagcccagcctctgttaacttctagcaaaatggctcaaggaaatatcagcacaaacctggttcttggctggcttctccttttcaccggtggacaaactggtggaaaagtggagggtcctgtttaaaagagagtagtttagttaaatcactgagttttatttcctcccaccaaactatgagttgttatggtaagatccctgagtcaatgccaatcttctacagtcctgggagcttaaatacacttggcaagcaacaccaagttatacagtttccaatacttagaggtatctgtgaatgcagatcttaatgcagtatattcttctggggctgcattttctgtctgaaacagagaatgtatcttagatgatgtgcttagcatagaacatgcttcatctcaggactcagttaggataacaacaaggcaggcacattggccagtgtcaagtgtgaaggtccaatttaggcccttactgtgttgaaggccgctgggcagatgccaggacagacacagaggccaggctccagcacagcgtcaggggaagtccatgccagggtgtacttgatctgatctcccacataacataaatgatcctagagacgaaggtcctgccaagagatctccaggtgactccaggagtccttgaggctgtgaatctttgcaccatactttaaatttctacaaagccccaaatgcctgtcgcctcctcagctccttttgtaaaggaacatgggtaaaccatggaccattaagagtagacaaagttttgccaagtccttggtgctatgtagggaagagcttctcagaatgttctactgggtccctctagctgtggagtagggcaaatgagcaccgggggtctggagggataacccgaagcagccccataacttgcatggaatgtttttgaagtcttgtatttatcttaataattcatgagaattttacatttctttccatgctatacccatgtctattttatattaaatgtagcattaataattgcccgaaacctgaaaaaaatggtgccccagaaagctgtacccacagttctcctgtagctgccctgggggaacataggccccagttcaaaagcaccgatgtatggcattaatctcactgattattctagaaccttctctggcccacacttagaaaaaccacaggcagccaggggcttgaacctaagcaacatgcacacaagttcagacccaacaaagggaagaatttccaggagagatttgtgcataggctcaagaagccttttagaaaatgaacaaacaaaatatctcatcataagtcagggacacctaatattttggattctctgaacactgatgtagtctacagagatcctcctcagaaaaaaaaaaaaaaaaccacaaaacatttcttaggtctgtgtgtcctttagagatttctagcgacctgagaccatctgtgggtccctaagaatataaagattcccactgagatcctttgtgcaaaggtcccttgtagagggcatatgttttctttaaatgttttgagccaacgtctaaacattgagaaagttcacactgttgtctggatcctggagacttgacagctttggacctacatgatctcatggctccatggaggggaggagctgccgctgcccctgcagctgggattccctgtcccctctgccacaccacccccattcctccttcacagaacccgccggcccctgtggccgctgaactggtgacttgtcatgccattaggtcatcgtcggggacatcaggccctgacagtggccaagagccatctggagtccatgctagtcatcacgtgccccagctgaccttccacccagacctgctgcagggctgtggctggagaaaagctgggtcaaagaagcggaagaatctacagatacatccagtactaggagcattggttgcagtggaggagttcaattccccatatggggaatattctccccactccacttggaatggagccatgagggtgagtggagagtcagagtctgccgcagccttggggcagaaacagcttcccagacaacatcggcaccttcccttgggacggtggtggctgcagcaacaaattaacacaaatagggtgacttaaaacaacagaaatgtattgtctcacagttctagaggccagcaatctgaagtcaaagggtccacagggccatggcaccctctggagactcaagaggagaatctgccatttgccgcctccagcttctggtctctccaggcatccactggcttgcggctgtgtcactccaatctcttctttctgtctgtgttttctcttttgtctcttctgaagactcctgtcattggatttggggcccacctaatcaatccaggatgatctcatctgcagatccttcccttaattatatctgaaaagatgttttttttccagatgaagtcacattcacaggtactcgggattaggactcggacgtatcttttgggggtcaccattcaacccactacccagcttcttagccactggcatacgtcataggcaacagcagcccctaataacaagtatcagtcatggtggtggctttgccagtgttcatggtaaaaagtgccctccatgagccagacctgagtggggaggagaatacagaaccacatcgcaacttgacttggatgcccttggtaatgagcatgagagcccaaccggaggacaccaagaggtctctgggagagatggaggcacatgaaagaggtcctggaagagtcagtaggggctgagcctgatttttttttaacatgctgtgacctatttgcaccccaaggctgctgaggcctggggaagtgcttaatttgcacagctgcatcctcatgagagccctggtctcatctgagtccacctgcccatgccccaaatccaaaccagtgtgttccactctcatgctctgccaaccagtatgaggtgagccatccaacactcactgagcatttcccgtgtgaagttcccatgctggggtacccctctccctagagctctagatggagagacagagaggcattctccaatcacctgggaaaagtcagttaggtgtggatgccagaggttttcatcgtcctattcctgtcccttatttaaaaagtgagtgggctctgtgttcactgtcccctggtgggatgcagtagaaataaaggcagaaattgcccagctttggtcttctggaagtctaagcccctgggggatttcagagaatctactgagctggcaaaataaaagggcttaggggtatgtattagcccattattgctataaagaactacctgaaactgggtaattgattaagaaaagaggtttaattgattcagttctgcaggcttaacaggaagcatgactgggaggcctcaagaaacttacaatcatggcggaaggtgaaggggaagcacgttttaccatagtggagcaggagggagagagagacaaggggaaagtgccacacacttttaaatgatcagatctcatgagaactcactatcacgagaacaacaaaaggggaagtccaccccccatgagccaatcacctcccaccaggtccctctctcaacactggagattacaactcaacatgagatttggatggggacacagaaccaaatcagatcagagtagaaacaaaaaatactggaccaataaacagaaggaacatttccccagatcaggcaattttccccaggtcagggagatattctcctggggtgtggggaggagactgggatagctcagcaaggtcccaggaaggcggcagctgcctggtcctcttaggtacttgagaaaggtatcttcaccccaaatggggctttgaacctcaggcctaattgccccaagggccagtcaatggactgtaatgtatatagactgatgatgaggcccaatgaggaccagaggatccactcctgcccccaccccactcagcagttccacaacctacatatgtccctgagaccatgatctggtcacagagtaaggaaagtgccttggtttgctagggctgccccaacaattccacagactgggtggcttcaacaacagacttttttttttgtagcacttctagaggtcagaagtccaagatcaaggtgtcacttggctatttctgaggcctctctccttggcttgtggatgactgtcttctgcctgtgtcttcacatgggcttctctctgtgcctgtctgtgtcctaatatcctcattacaacactgatcatatggatttagggcccactctaatgatctcatagtaacttaattgcctctttagtggtcctgtctccaaataccatcacattcggaggtactggaagttagaacttcaacagaagaattttaggagtccgaattcagccctttacaaagaggaactttcaggaaatgatccagcttggtgaagaaatggttctcttgaaataaaatttaagtaaataaaaaacacagatttctcttttgtacacacctcgggatgtggactgattcatgcctactggcccccacaggtgccttttccccaggcaggaaggtacagatcctgggaggggcatgattgtgtttttgttttttattttttaaaggaaatctccaggtgattttcagtccctcccacagaggcccactgctgtgccaagtgggcacagggcaaatcccaaagctcttgctcagttataagacaaatagtcagtaggtgccttctataggcgaagcgttgtgcaaggcacctggaggaaaactaaagtatgtggcctgcccttacctgttatatacagcaaggcgctcggtcaaagcaaagaaagcccaaaggcattcccaagcttggtgctccagacctccctgtgcactcacatgcctgcgctctttactctcatccaggttctttctccctccctagatctgctaagaagtgtatatggatgggtcaccttttccaaagaagggtgggaacgtcctcccatcaagggaaacaagtgtcctgtggtggcaaggaataaggagagtgaggaatatgactttgtggcaaatgctttaacttggacgtaagagctaagtctggcattgctgcaattgaatggatactattgtcccaactttgcagaagactctgcgtatcttactttgggatcccctgaaagtggacctttggacaaagattttctatgcaagcagtttcttgggcagggatccaggaagcacagtgagggagaggggaacaagtgctgggaaggggaggggatcagtagaggacacgctagtcagtgggctactgctgcaggcgcatggggctcagtcccagtggggactctgaagcctagggccatgagctcaagtaagcatgcattggaataaggagaatgcccagaccttgtaggattgttggtcatagagtctgaattgacattgatagctggggacatacgggagccaggtaatacatggagtcctggcccaggtctagcttacagtggatttgtttgactcatagaccactgagtggttgttttcctaatcactcaatagagagttggaatgaaaatgcttggtggttgtcaaaagtctcacattggaaccttgacctgtagcataagagttttaataccggggaaagccaaatagaaacccaacccctgtccttggtcaaaataatttttaaaaaaacaaaatgcatccccaggagaacaatggagcttagtggtaccagcaaaaatttgaagaaggcaagggtggtatcattgccatatcccaatttaatctgttagggaagcaggagcccaggcgagccaaagtgacaccatttttaaatcaattccatcttaaaactggcaaggcatatttcttgccagtcacgacccatggtcctgagatgtttacagctaaggaagcagcttagtgatgctacaaggacacactcctacaacaacaaaaagtccagatgtcccaatactcatatatgtttccaagataattatagttacgctttgatgtacttacacactaaaatgtcaaggatagttttatttaaatcaatagaataattttgtcatgctgtcagcccacccgtatgtgggcacaacttggtttagtctctacatagacaagacccctatataaaaaattaaacttaaaataaagatgatacattcctctgcttgcttcctgaggaatgtaatggagtagtttctaataaacttgcttctttcactgtgctctgtgacttgccttgaattctttcctgcatgagatacaagaatcctcttttgagatctggattgggaccctattttccagcaacaaatccatcagtctggccactacagaaatcagagggtcatggagatgacaacgggctatcacaaactcaagcaagtagtagcatccattgtagcaagtgtgccatacgtggcaaagagagattaacacagcctttagaacatggtgtgcacaggggtgctgcccttgacctggaaatgtgtactttgccctatgtatcagcaaaaaagaccagaagtagttccccttcatgtaggactgatatagatttctcctgaggcctctttccttgacttgcagacagccaccttttcactgtttccttacctggtctttccttcgtgtgcacacatccttggtgcatctccccctccttataaggacatcagtcatactggattagtgtgctactcttataacctcatttaatcttaattacctctttaaaggccctatcttcaaatacggtcatattggaggttaaggcttcaacccatgcatttgaaagcggagggacaaaatttagtctgtaagaggcaccatggcacagatagacagaatgactcagccagctatgatcagccatctcaattctggcacaaggagctcacagagtagctaaggtgacagagaaggagattcaggttgtgcctggacctaacagcaagggctccctctcatcaaggctgatctagctttggctgctgctgcatgtccaacccatcagcagcagaggccaacaatgacacagagacctgtctagcccaagtgcgtgccccctcccaggggacgagtgtcgccaatgactggcttctgcatgggtatgtaggtccagccccttttcttcaatttgggaaaactctgatggatcattccggttatggagctcctgtggaagcaactgaggtctcagtcatagcaccatcacaggtcagcttctctctctgcccagttctgccatcctcactcccttacatgtgtatctcccaagaacactccccaataaacgtcagcactcagctctcagagtctgctttcaaaggacctatgataagacagtaacctttctaaaactgatctgagaatgagcctgcattcagaatatactttccccactgtagaacactggtgcccctcatctactttaaatatttctgtggcttattaccctagttgaaatacacacctggcattctacaaaaggaatcgaagtattgtctcaaaagactatcttcataattaatcaaggcccactgagccatagggcctccagcctttccctaactgagggatacttctgctaatggtgaagcttggtgttaaaaataatgtttagacctgttttgtgatattctgaatgtagaacagccaaagccatttagattagtgtcatttgttctcataaatgtgaataaaatgctttgtgggactaccaaattctttaaaacacgttacataaaatgtgcagataatcttaagagattccttttagagttggtgtgtttcattcaataaacttgttttatcaaatcacataacatttatttaattgtcaccaatcattcttttatttcatcatatagagtattgcatatttgtcttatttatttttttttttaccaagaaatgaactttctaaaacttatgaaaacatttggacggtagcttacaaaaatacacagtgatagatagatttttccttattctcttaaggtgtatgtggaaaataaagtacaaagatcaatggagaaactaatatcctcctgcctgcccatgttttcaagcaattaataaataagagaaaagaagaagcaaagagacaacaaaaatatataatgacatcccttcacatggggtgggggagaagcaccacctcctctccaacaggatacccacaccttccagattatctgggtagacctcaaattccaatactctgatctgccatcctcagaagatcacgtaggactgtcagataccttgttctctttggggaaagggtatagaacacagagtcccagtaatcacacaccttcttacccagcctacaatggcttcagagcacagaggctgcagtgcccttggcttcctgaccaggcgctcctggttggccttcccccagcacttcccagcagacctggttcctggtagtgacgcctttgcttttcttccaggtctatttttgtccagagtcgccaattccccaccacaagtctccgttcttttcccccaaggaccttcattggtttccctaaaggggttttcccttgcccaatcctggtgcctttgagtcacagccggcatccttgccagggggccaccagcccattctgctagctgaccaacaatcctgtttttgggtctaaggaaaagtgtctcatgtgatcatcagagcttgagccagaggacatatatgggcagggcttagaccaagggccaaaggcaacaggccccaagtgagggcagagatgtgaagtcatagatagtcactgctgctccaggcacccacctgggagagcctgcattgccccatgagtgaccaagtggtcccattcctctggatatagcaaaattaagaaccttagccatgaagaggtcaggaggcttaaagggacatttctgaagttggggcctttgcacttgaagttatccaagtagttgagcattagacgtcttcctcttaaaccttgtacgctctccaccaaaaggtttgaagcctggtaaaactcttgaaaaaatgcacaccattgtggtagccatgtcttcaattagcccctatccatagagcaacattttagctcagtgactgcaaagacaccctctcttcttattttatccctaatgcttaggttgctgctggctaatacttagtattaaataatttatttaatactaagaagaattaaataaatattgatggcatgaatgatcattctgacttgaaagggcatttattgaactttttagtccaccaaacaccataagcccttgatttttatttcttctgctctaatttctcagagcttgtagatatttcctagcaggtcatcgttgccacctgggcaagacaggaaggctaccctcatcccactcacttgttctccttttgatcatatactctcatgttcgccaatgcatcaaattggtgaccttcttctaatcacagacaagtacaataagattggaaggtgtcatgttttggcaggtgaacctgtttctataaggatcctgaaaagaccaaggtatatttattaccctcagtttctttccttgacttgctctttgcactctgatgggccagccttggaatatctccaagagcagctgttggcaggtctttcaccccaggaaaaaattatcagctctgtattactcaagttgtctctaaagatgttggtcattagccacttcactctctctcgcctgcttgtgaaatatgggttggattccttctgacatgttacatccccagttgatctcctaaagcaaataggaatttatggagacattcaacccaggagtttatgacctggctgggagggaaaatctcctgcacaaacatcttctctaatttttttgtatctttcccatctcaacattcccacttcccaaagactctaatgaaacagaagcacagtttttgattgagcacccagtctgtctactataatactctctggatcccttgttaccaatatatttataatcctatttctaactaaggagtttagttataagctaaactccagcatttcctcaggaggtgctggcctcataaatgtcctgcaagcaaggaaagtagatcttccaggaatggcaggaatcacgagaagactgaagggtcagctctttaattggaccacctcaatcgtttgggctgttaaacaatatttttgctcagtctttcccacattatagtaattaaatagttccttccacatcctcaacaaagtcaaacacagcagcttcactgggtgaaaaagaccactcttgatttgggtgaaaaatgttctttcccacccgtgaggaaggccaagcagcgaatcctcccactgctgagattagagcagttatttctgctaacactgccatcccttctctctccagaacactttctctgttatcaagttgagcaaagcaaggaaaaagtaagctggtcaaatgtttacttggttggtgagcgttgataaaatgttggcctctgtgtggttctggatgagacatgcaccccctgacccagccagccctgggctacaatgagaacgaaggagcaggtgatagctcttaaacaaccagccagtcccaggttttcagcccagtgtttgttcacttatcccagacgcttgactcacgagggaccgtgtttatactggctctgtcccagggtcactttggttgagtggtatccattggtgtggctcctacagcaaaagaccaagtcctgatgccaagagagattaggagtttgcaacgggaaagaagaggaataaacaaaaaagagtggctccaagtcaagtaagttgctgagctgacttgagcttgtttctacttgtgggaaactaaaatcaatctctggtctggttgaaataatcttcagactgtctgaacaccatagttggtggcacagatttacagacatctcagcagattggagtgcagaagagcagagagtaagtgggttatgagccagcttaaagcttcactcaatggaaactggagccccgtctttccagagaggcaaaaaatgaataataataattgtgatgacgatgatgatgatgagacattaaataaacctccttggagctttttgctgacttcttctgctggtgcctgcactttctgcctccctagaggttccaacaaaccttctgactctaaaaggaaacccttctgagaccaaaaggatagccaattatctcaagttttacagcataaataatctaattggatactaagaggagtccagatatttgcacaaaaattaaaccgtcacacagaagggtgttatacccctgcctggcctccttcttcctaaaagcctggagagtgaacagacttgagtgttgaacgacccccatttcctcctgctctaccatgagtgggcaccatggcctcaggcatgggaccaacctctccatatcctctcagtttgaggagggaggtgctatccactgtgcctcccttgataggagaaatcaagcatgcattgaagcccttgacaaagaaaaaattgctgaacagaagcaaggtctgcaggacatgggtcctattgctgctgggcattttgcaaggataaatattacatagtcactcagtttggtaggaagtttgctcacaagaattggaactggaggggctggaaaataaaaactccaatggaaaaggctaaattccttttatcttcattctttattgttaactacttaagccacataatcccctcagtgtcaggtatcccaggccaagaatcctatatacccaggcacatcgccacccctgcaccaccaggccacataatactagaaattcattcagaaaaactctttccagattgattaattggtgattgaataagtgagggaaggaataggggaaagggcagaatcagaaaatgagaagcgaacgcaggaagacaaaattagcgtggcaggtacaatggcacctgcccagatcccctctctatggacagatggccgcagctgccaggagggccattatacccttcagaagtggctgcagttgcagagagatgcctgactagggcatcccacaactgacagatccaggcaggtgtataaaggtaccactgggtcattttaacccaatgctgaacaatgctgctaagccattttagctcctgagcttccctggcatccgctgaggctgtctcctctgcatcactgctcagctcccacctctgtccactcaaacttttcttgtcctcacttccactggtgtcgatctcaagggcaccaaatatcctatcccttaaaatccattaacaaatatcctatcccttaaaatgcatctcagaatctgcctccagagaacacgactgtgaccactaggaaatgtagccaatggaaattctcaaagactaagaggagaatgaagaaggcaggggacacactcatcttctttgtgctgtcattgccattccttgtctgggtgtctgcttcagcaaggcactggagcacagtgacaaagaaacatgtgttaggttcctgggacctctttctcaccttagttttgtcactcacgagctgtgtggtcatggataagtcaatgtctcagggcctctttttgcaagttaagaaacaaggacaataatgatcctacctgacatttgagtcatcatgaggatctcctacgaccgtggatgccagtgtgcacgggagatggtaacaccccatctgctagtgacatttcccccttctccagccaaagcttggaaagacagcaggaccttgaaaatggcagccagaaaggcagccatttccaccctgagcttcaatccccaggctgaggaagtccttgcagggaggagttagctgctagaagtcatgggagaggggagggtactatctcattaaactctcacccatagatcatattgaacacctgctacctatgtgttaaactccaggccagtccacacacatagggagatggaaattaactaaacctgcaaacaaataaaaacctcccacagggaataagccaagtaacaggagttacagaaggcctccctgaggaagtcacacttgaaatgagaactgaatgacgagaaggaggtatgtcgacaaaggaggaagggaaggtgattgcaatctgagatgaatatgagtcccaagaagtcctcatggtcaggggagcagagagcagaaggcctggaacacgagggtgaagctgggagaagttgggaggcaagagctgaaaacgggctggggagaggatgagggccaagttgagcaagtcctggcaggtcaaagactattagctttatcctgaatacaacggggagttgtggaagggccttaagcagcaggcagatggttataccagctgcagagggaaggatggatggcagggaggtcagagtgggtagcattaacaaccatgagcattggttgatttactacgtgcttgacacagttctaagtgtttaaatgaagcacaggcacccaataaaataggtactattggccgggtgcagtggctcacgcttgtaatcccagcactttgggaggccaaggtgggtggattgcctgaggtcaggagttcaagaccagcctggccaatatggtgaaaccctgtctctactaaaatacaaaaattagccaggcatggtggctggcgcctgtaatcccagctactcaggaggcgtaggaaggagaatcacttgaacctgggaggcagaggttgcagtgagtcgagatagtgccattgaactccagcctgggtgacagagtgggagtctgtctcaaaaaaaaaaaggtactattaagatccccattttaaagatgaagacatgaaaatacacagagaacaaacaaacatgatgccaaccaagctgtctggctgcaaagccatacaggtaactacacaatactacatggtgggtagaccagatggacagctattttagtaatccaaatttgagtgacagcagtggaattggaaagaagtggatggattttcaagcgtgtaggagatcaaaagaaaagtcagaactcagttacactttggccacagggatgtggggagatggtttttgggagagtgatggggtggcagtgagagacactgagatataggggtccagaagaaaaccagggttgcagtatcaggacggacaggaggtcggggacagcatgagtccactgggacttgcagagatttgagatgtcccggtgacatatttcgtagtgttgtattcttttaaggatacctggttttatcctcctacaatattctggctctttctgtttgactacgatccatctggaatagtcacctgtttaatataatctggctcctgtgcacacaggaaaggagccactgtctcccttaaagtccccttccagaagcaagagtgtcctcacccctcctcagcccagcacatcctcatgcgaaatcatcacgggaagcaggacagtccctgctatgcaaggagagggcagttgagcatgagggctggttaagagaagagatttctgagcccgactccaagccctacgatttatgagttgtgagattatgtctttgcccaatttattaatctgtctaaacctcagtttttctatctgtaaaatatggttcttgagaggctgcaatgagatgatatacctaagagaaagcccagagcctggcaggcaatagccaagcgatggtagcagttattatccctagtggaaatcgcagcacatgaacactcttggattgttgtttgtttcacagctcgagtctctggaactggaggaatcccttccagttacctcctgttcttgcttttcggatgccgggggcctctcttgccagaacagcggtcatgagccatgagggcagtttctacacatcttcctagacaggatggcttggcttatgatctggaagatgttttgccactgttcagccacaagaatggttgtcatttgctccgttgcttgtaaaggaaggctcgtctatggcatttggttagtgagagcagcagtttagagaataaggaaagaagtttgtttgaagagagtctcagaaagtgaaaggtaactgttttacacagatgatggatgaagcgactccttttgcaataagcccttatctttccttaaagcttgttccaagggggaaagcctatcacctggcctactgtgattcttggagtctcctctggcaaaagaggtggcagttgtggcttgcctccatttcgttttctctgctgagacctccagaaagtcaacctgcctcagaaggtgcaggtcccatgggttgtggcccctcacgggatggttacaaggcaggcaactgagtcacacatttcgttgcttcccaggacactggagacttctcaccttgagggtgggagaggtctgacggtttgaaggaaagagggattcctacatactgcaggtcttggtagggaaaatgtctttgtttatgaagccttggcgagcacaatcatgagtgatttggggaaggatttcctggggaatggagactctgtgaaacagacaggtctcgcctcatttctctctagtccctggcagcagctgctcacaggaaagagtgcagggtctttgctaagattcactgaggttccagcactgcatagaaacaagtagctaagtgtcccagtaattgtcaccatctgtacctaagagaaaggaaaacctcacgtgtgaccatctttttttttaagcaatcatttcttgagagaataaagcagaaaaacctgaacttatccttttgcttgtactaggagaaagagaaaacgcaacaaaacacacacacctgacccctagctaacctttctcaggatggggatgggagggtcctgtctggaatctcagaagttggggcttcctaaggcacccctacacccccgtttcctggaatctgctaaaagaaaatggaaaactagccgagatatttgactgaggtttcttaagaaaacatattctcggtttgggttgttttctgaggggagggttggagcgatgtggtttaagtaagaaaattgctcatgaacagtgatggaaatagtgactctcttgactgttccacatgtctctggctatagttacaggaagcaaagtggaacagtgtttgcgaattacctggggaacacgggcagagtggacaactgatctaaaaggctggagccaagaaaacatcactgcatcagtgatctgggtaattccatggctggagcatgtgtttagttacttaagtggaaggtggggacgatcttatttcgggagcctggctagactccaagatgaaataagataacctacttcatctaatttgttgcccacactccctagagactaacgcatctcaggtctctctgacgtctatcctagtgaatctcaaaagatttattttcatactcttttaataaggtcagtcaaccaaaatctaaactacttgacttgactttgaaaatggttttagaatcacagttcatagtataagagcacaaacagtttccattatctttgaataaatccaataaataatattcacaaattctaagacacagacaattttagttgtttgaccaacagaatcagtttttctccggtgtatctttgtggttagcctttatgatgtcacgtttctgctaccaactatctattcagggaaagataaacagagggcaaacaatatttgtttataccttttgggctaaagacacaaaaattctgcttaattgccttcatcaatcagtagaagatcctaaattcctggggatcatggagctcaaatggttagggtgggccatgtgtacacagtcattcattcaataattcattcactctctcagccagtcaataagtgttgcacatctgcaaagtgcccggcactgggctaggctctgggcatttcaagatgaataagaccccacttctgaatgacgcaaagagctttccagctacacagtggcatttgtaatgtcacaggcagtccaaggagggagtggttacttcacagaagtcactagagaaaaagagtatttatgcagggcctacaaggatgggaaagattttggcagggagaagcagagggctaaggagctctagaaagatgagtttccaagtataagcaaactgaggaagctggaaatgaggaaaatggggtggtcagcatggctgaagcttgggaaatgcggagcggagtggtggcaagtaagccactgacaaattgccgagtttcttcagaagtaacgagtggggcttttctctgtagtagctgggaaccaaagaaaatgtgtgcgtggaggcagaggcagtcagggatctgatcggaaagttcagtgtgctgtcaggtgaggaatgcattacacaggtgggttggaaatactgggataggaggcaagagatacagacttgagcaaatgcctgagagggaagcagtaggttgctgagcagggcattgccgagggcaagaggagaaggaggtggctgtgcagagggggcaggccacccatctggactctgtcctggccccactcttggcagctatgggaccaggtttaagtggcctccagttcctctggagagagagaaggactgggtacagcagcccctcccccaagcctattgagacatctgtagggaagagagttcagctcactgggaaggagaagccttcaaggctggagagcgctgtggtgatgtggttatctaactttgctgtgggtcagaattgcctgggcagcatagcaagcggtcccatccctggaaactcagactgggctgcctttgtagctgcaccacactttggaaaaccctaatctcacatctggggtgttttctgattctctgtttggaggattctgaagctcagaggggctgggtgggtccagcctgaaaggggcacatcccatcacctctctctcctccaccattcacagggacgcccaacacgatgccctccgtgtcttcatctctccctctccacctcctcagtccctttccctggacttcatgggagcctgttgagctcaaaagatccccaagagccaagatgcaagcctgcagatttcaggacagctggtcctggcgctgctggctgctcgcaagggccgggcctcctcattgccgtcaccagcccccgttgggcctcatcagagcaagaccaggctcggctgatgctcggcgctgtattccttgacgcctccatgaggcttgctgcccagcatgtcccaggcttgctggaaatgctgaagctcaggctcacctcagacccacgactcagagtctgtatcttttccagatcctggagtgatcgcatgtgcacgtataaatcggagaagctttggcttccatagcctctgctggctgtaactaatccttcctcaccccatactgagggaaaagaaagaagggaagggagggaaaggaagggaagagaaaggagaaggaaggacagggggagagagagagagagaaagggaaggaaggaaggcaggaaaggaaagaaggaaggaaggaagggaggaagggagggaaggagaaagagaaaggaaggaagaacaggaggttaggagagaggaatgaaagaaagagaatgggagagggacagagggagggagagagaatgattctgtgagtctcttaactctggtcctcctgttacacatcttttcttctacttttcctttgtttcacacttaagctttgaagatgtaaagtaggaccagagggtgagaaattcaagaaccttgaaataaaagacctttctgtttgcttttcatttcctaaaaaggaagtcctcactgactgttcctgtaagggatattaagctgtgtggattgtgagtgattcgtcacacagcaatttggagcaggaagcacacgaaaccctagagctagcctgcacgcaactaattgaagccctcaattaatcggattggcttccaccttcaggagaaaagcaaatactaagaaaacaaattagcacctggaatttaacaacttcccttttttggtgtgggggcgcattatattcagagtacatgataactgatggctcgtctcataggcacagacatctttacaatcctctaaggcagagtggtgtggtggaaacggagttggcagaggcatcagatctgcccgggtttccatcccagctccagcatgcatgggccatgtcgcttggcaagcagtctcaccactcagagccttgatttcaggattaaaaaaataataacctattcaacagaatcatggtcgagaagattaggggtttgtgcaactcctcacctggtggatactcaaccggaatgagttctctttctcagttcctgcctacagatctatagacacttagctttaaaagctttgattatggccagttgcctggtcaacctaataccagcagaggagtgtattttccctactatggtggaacagaggtaaaggttttccaagtttgaagcaatcatacaaacaaaataggagcccaaagacttctgcggagctttggaatgagagatgcccattctggtttcagaaacgccagcgccatctcttggaggagcatgaaattgtttccttgggctgaagaagcatccatggggccccaggtaggttcagctggtcctctccttctttcaactgtagtttcagactggaaccccagggcttcttccaagggaaacattcttacttatttccttataaaggtcctgcatacctttgtttgtctctcttccaatcaaaccattctttctctctaatttcatcgggtccagtatttccaaatttcagtcccagtttgtaaatctacaactcaagccaaaccttcaaagactgaattttctaagtggttagttatccttctaacacagagggtcttccttctaacaccccagcagaggccgggtagcctagcactcaagatcctggactctgaagctagaccactgtgtttagcatcccctcagccttccaactgtgtgaccttggaaagttacttgacctctctgtgcctcagtttccccacccacaaaatgaggctgacagcagacaccacctagaatggttgttgcagcattacaggagttcacacctgcagcactcggtgcaggcctgtgacagatcatgagcaagtgtttgccatcatcttggttttcagtggctgttcccttacacaccacttacgacgctgggctaggatttcacttgacttgtccaggttacccaccaggcggtgtttctgtagcatgggcagtaaaggcagcataaatctaggccacactcacaaatgcacattgttagcacacaaaccccgtgattcagatgcaggtggtctgggggcctgatttttagagctgctgcactcagttttgtgctcctagggggcagggactagctccatccatctcagaccccagcctgcatgcagcaagcacccgcccccttgaaagtgctcagctcaagttgctttccttctccatcttctttaataaatgatcttggagtgaacaaatgggaggctgacagtattacactaaaataacaggagtttctggtcacctgagaagcacaatggtctctcatcttctccttactccattaggagttcatatgcctgcattttcctcattaaatctgaggtgcttttctgaactctatctgagaaggagctgaagtaatcaatgagtgtctcacacacaaacacatggaaacaggttcttagtgagagcggtggggactctgactccaaatttaatgatttttcactaaaaaggaatgacgcttcccttcactagaaagcaatgatgtcttcggtggttgcatcaatgaccaaacatgtataataaactgcttctttgaacttgaggacatctgattaagagatagaaagcaaaacaagccttcacagatggtaatagtgctgggacacatcaccttttgtgaataactgaagagcatatattaataacagaaatcacattggtgtgcccttactgaggatcgacaaaggagaacacgtctatgttttgtggaaacacgactgaagccttcatccaatgacgttggccggccccgctctcctcgtgccatcaagcactctacgctgactcagtagagcagcacagccctgtgtgtggagagattcccatgcaccatgggaagagggaccaagcctgggccctggagggcgcagccggtgcagtctgcaggaggctctgtgtttcaataactgtggtgtccccacaccccaagggccatctgtagatctgctgctccaaagtctctcacagtggctcttctttggaggtcactctccagttaagtgggggaccaactgcaaacttctcccatcaatatgaactgcaatatgatattgcagcaaacaaaacacacacacacacacacactctcccagaagcatttaacaggagaagtgtgtacctacacatttagtcccaagatctctttccaggccctgtccaggttcgtggtggaagcctgtcctctgcacactggcttccccaaatcttcccatattccagagcaggggaatcctttctccatcttttggctcagatctactgcggagtgtgggagaaatattaaaagtaatgatccttgatggttaaagctgccttatcaagttcctgcccctgggtttaaataaagtctctttttctgccagctttagataaggatggagggtgagagaaacagacagagacagaaagagagagagaagaagggagagaggcagagaagcaaggactctatagggaaagaaagagcttggacattaattcattttatgaatatttgttctactcttcttaagaacaaggtttgtcccaggtgccttgggggcaagagagaatttaaggggtggcaaggggccactgtcccgcatcttggggacgttgtaggcaggcaggtagagatgtgctaaggttcccgggtcctggagatgccaggcaagttggaaaatgcagaagaggaggctggggtggacaggggtcattttggctgaagctggttatgagaggcttagaaggtgaaagtgtctgctgtgctgggccctgaaatgtaggtcttcttggccacagtgggaaaggggagccctagaggtccttgaacagtctgagtgacaacacctgggctgcccagccccaaaggccaaaaccaagacacgtctttgtcccagaggttgggcttggtggctgcagctgtggatgctgaccctttcatgggcatggggacaggtgaaaagcaggagcgaggcaggcaggagtgggtgccagcaccagcccacagccatgaggcctgtgccaggccagcctgtggggacactgggtccccgagagagacatggaagctcccgccagcaggagacttgaaggtggtcagttctgaagtcctctcctccttaggcctggacctggggacacaggctccagccagcagcaggagcccatgaaactcatttgtcccaatcttcttcccaagtctcaacagctttcggggggttctgtgacagatgccccacttccagctccacagccagccctacgctaactctgacagatgaaaggcctcagaatccccttcttcaattgtactgcacccaacttgtggaaagcaaaacaatattaaaaatactttttaagaaactctagaatatattgtcatcaaagtgatcacggttctgcttatttttggtcatcgcaaccaatgtactgagccccctttgcccagaccctagcaggtcctgagtctcagcgtccacaaaacgaggctatggcccttggggagttccgtgcggtgccacaattggcctctgagttactctagagtgataaacgcagccttggcagtaaaataccagagaggtaatgagtgcggactccgtgctccctccgcaggggcaggtgcgtgaggctctagcgccacctcgtgggccgtgggattcgtgcccatctcctcctgggcgggagttcctctggagccaggaactctttgggctcagggtgtctttttagaaaagcttctgacgttggttcttctttagtggaccttctccggtaaaacggggttaacaactccaaacttttccccacctaaagggattgaaaggctgtttcaaaggaattagagctctgagactgcaacccacaaaacacacaatagcatatacacagagatgcacatagaaacatagacacacagggacacacaccagagatacacacacacacacacacggacaggcagacacagggccacaaacacatacacagagatacacacagaaacatatacacacagggacacacaccagagatacatacacagacacacacggacaggcagacacagggccacaaacacatacacagagatgcacatagaaacatttacacacagggactcacaccagagatacacacacacacggacaggcagacacatggtcacacacacacacacatacatacagtgatattcaacaagggaagggtgcacccacaggctcagtcttgagacctctctccaggctcctgggtgggttggggaagctgagcctccctgcctgctcatagcacacagcctccacaaatcttgctctattccagagtgagaaaggaacgttaaaactgatgatccctgatggccaaggctgccttatcaagatcctgttcccgattcaataagaaaagatgcctcttgtgccagcagcagataaggctgcagccctgggcgttcccaggagagcgaacaatggaagcccccaggatgcctctatatgaggtaggatggttacttgcccagtccctgcctgccaggcccttatctgggaggcgctggttcgggttgcaccctcctgtgttcctagcgggggctgctgcacaccaggcttctgaggccttcctggtgggggttggtggaatggcggcggggggagggttttgacggtgcatcctgaagtgctccctgcacctttcccagaaaaagaaaaggatgccatgaaaacacttcaccctagacatggtttaccctcgggaaagctgatgtgaaagaagttccagggggccagggatagaaaaggatttagaaagatgaaggcaacagacaaacgacacttacaaagtgcccaaagtctgcaagtcctgatagtcacagggaaggacatcagctggcgggaaacctcaccttttaggcctgcatgtcagtcttgcactgctgagctgtgtgaccctaggcaggctacttaaaccctctgtgccctggcatctccatctacagaataaagcttctaacagcataggcctcacacacctgtgtggagaccccataagtcgacaacatgtgtttacccgaggaaataaatatgggtgcccctttaggcctgtcccacagagttatacagctgaaagacctcagagtaggtccacaccccttaccaagtaatgcaggccttgattaattgccacttgaagggaggtggggagaaagcaccctgtcacatcacagctaaatttactaaaaaagaaactctttgcccacttatctttcgaaagtgcctcacagcagagacagccccaaccccttcctctctctccagcctcacctctcctcctaaaattcagttcctcctcacactctcagtgcctggccccggccatgcattagatgccctgaagagcttttgaaaaggaccaatccctgggccctatctcaggtgtgtctgagcatctgtagattttagaagctctgaggaggatttacatgcatttagggtggaaatcacttgtaagtaaatttttttaactgttccctgttaaaaaatatgaaccaatggaccaatggaccacttatggcttctgctaattctcttacatatgcccatggtaccttgttgcagtatcatttgtataataaaaagattggagccaaccagaaagtccatcaatggggggaaaattaaataaaatgtagttcattcagcaatggaatactatgcagctctgaaaaatgaatcaggaagctttctatgaacagatgtggaaagtctccaatgtatagcattaagtggaaaaagcaagacataatggtagtgtgcacgttctatattacaaaaaatgtgaataaaggcagtttatattcatgttttcttggatatacatttaaaaaactctaaaaagatacacaaagaatggtctagtagtcattatagggggtctgggaaggcaagagataatatatcatattttcaaatttttgaattatgagaacatgtcattcattcaaaaattgaatgtaaaaagggttaagaaagagaataaagcaagggccgggacacatctccactgtcttcccatggccctctcagaagtggatcacacctggtgctaggcagggggacagaaattgctgtggcctgagcagagcctgggtccagccagcatctacacagcccacgtcctcccaggggaatttctctgtgctctgttttgaggggatggtcctggtactggagtagcagagccaggtccctgcttcttgcataaccctgaggctgccctgtttgctcttcttgtgtggagggcattggcagaggcctctggcctgtagaacctttgtgagctgagccacaactcacttcgagctgttctctgccctggctttgctaccctgaggtctccagtgccatccacaccttccgtctgccactgccaacagccacaggtgatggatggggaccataatgtgagaggagaattgtgtactggaaatcagcatgaagggatatccaaagacctggagaaacccaaatcacatggggatgggagagtgaagacccaagggagggatgtgcggcaagacctgctctgagctctgagggtgcagatgtaatcaagactgagtgctgccccaccagacctgtagacgaactctccttctggtgaggcagtgaacctgcaagcacgggaaggtggtggtgggttgggtgccatggaggaaatgaggaagcaggagatacactgggggccaggtggggttgcaggtctcagcagggtggggctgaggtggtgatgggtgagggagtgagctgtggagtatccagacagggaaagcagcaagtgcaaaggtgctgggacaggagtggattttgcgggtctgcagggcagtcggtgtactgggagtggagtggatgaggtaggacatggaggctacagagtctcagaacccgtcagaggctggtgtgcagtcaggttctgcagggcattgttggccactaggaggattacaactttttctcttaccccaagtggacttgaaaccattggagggtctgagggaagagtgatatggtcagatgaagtttttaaatcatgtatttaattattctagttgatgtgtagagaatggaattggtgagggaggagagagtagaagtagggggacaagttaggactgatgggagattgagttgctccttggccgtcacaggattctgcatcctctgcctttaccatgggccttgcctgcctctcccagggacagagtgtacccctccaaccttattgactgcgcatttggccatgtgacttgctttgcctcgagggacatgagcaaaggccacatctgagcagaagttttgagggccattgcctggttggctcttgcttttttccctctgctctgagaagaggcatttccaacagggggtaccctccagtccaggtcctagaatgggaaagcctatggagcagggctgccaccgtggcacacagccatgacagaggtgggagtgagaatgagatggctgtcgtcgtaagccttggagatgtggagagtgctgaccgacacaggggcccttggggtaccagactacagaggcactgctggaacggtgtgaggtgagttgactttgtaatgttttctgaacagcagagctacccaaattggagtttgatgtatggcattagggagagtttgatttggtttagggatatgttaagttcgagatactcattagacatctaggtagaggctggagttcctggaaaatgtcaactacaggtacaacttggagtcatcgtctcacatttgcaaactcaatatatgcaaatggtatgaaaagtcatgaggctatacgtgatcaaccagagagagggtgtagaaagaggtgtcttcttaggacctggggcactccagcatgtgcagaatggagatctcaaagggcgagtgagcactgacctggtggtggcataggcaggtgcatgtcagggagagagaacctgtgtgcaaatacaaggaaggtgagtgacatggtttggctgtgtccccaccaaaatctcatcttgaattgtagctcccataattcccacatgttgtgggagagggcaggtgggacatacttgaatcatgggggcagttctcgtggtggtgaataagtctcgcgagatctactggttttataaggggaaactccttttgcttggctctcgttctgtctttgctggctgccaggtaagatgtgccttttgccttccatcataattgtgaagcctccccagccacttggaactgtgaatccattaaacctcttttccttttataaattacccagtcttgggtgtctttatcagcagcatgaaaacggactaatacagtgagagagcatgacaccttcaagaagggggcagaggacaaactctccagcctgcctgggctcatgcccagcactgtggcccttctctatccaggagccttccctgtcattatgcacaccctcagtcactgtcctctgcttggcagcacctctctggactcacggtttgtggaccagtttgttctcattaatcccacgacttaaatttctagcacccatgacacacaacctttccctctcctaactcaacccctttgtcactttcccccacttctgacgtaaaggtaacccatcttccccaattacaatttcttgtggcccagccttgccccagtaccaatttttaggagatgatttttgtcaccataggttttattttactgtgaaaggcataagatttgtttggggctcttctctctctatgtccaccttccctgccctcaagttcaccatgctcccccagcatgatctccagtcttccctaatggctgttggctccacttccctccagcactctaagagttatcagcctgcagaattatgagctgctcaggtcaccctacagcaagtcactcctcccacccagatcattctccctcaacccatcagagcaatccctggaaaacaggaaggtggcccttcactccctcccctgccacactcccgcctggtaattccaccatggctgctttcagcctcacagggacctcaagtccctggatacttccatccatgccatgatgtctggaactctcaagaaatattttggacagtttatctgcctgctcttggatttattgagcagggaagaaactctgtaagttcacatatctctactctatccctgacaattttttctgggactggagaggaaccagaaagggaatggagttggggattgaggaaagaggggagaaacaagagaagggaataccttgggcagctgggcaagaagaaacaaagccacaccatccagagacagggattttggaataactgcaaagtcacaaaagtattgggaagatgacttaatgcccttgaattcaagtcctcagacatacacagatattgtggtgatcatcatagcaaagctagccttcccaggaaagagaatgccagaggttttcctcagaggaggcatagaattagcctagccagtgaccagttagccagtgaccagttaaaggacaagtgttgactttgactttaccccagtccactcacgctgccacccccatgccctacagacccagccatgtccttgtgtaaagcacaccaggagacaccaaaggtatcacagagcaggtccaagtgggacatgggttctgaaaccttaatgcaaaccaatggcatgctggtatctgatcccaccatgaccttcatctcgagaaaggtgccacgaggctgtttcttgaaaggaagttttgttgacctggttcctatactgaatatgaccactcactacctggatttctttagccatttggaataggagcaagaccacaagcgctcattaccttcctgcatgaaattacatctcctgggaggaagagagccataaacatcaaggtgggtgtcacctggtcttaatttcttggcttcattagaaaaatctgagaacttggaatgacatacccacagagaacatttgggtttacataaactagtatatccttcatgtataaatacatagtttaatgtaaaagaattgtgggcccaaaccaacagttttagggtatttaattaggatattattcaataagcacaaacggctcttcctaggtcggtatttgattcaccactgaaaaatttgaaactaggaagcaaatctctagagaagttgcatttattattttggagtaatggtaaactttggggatttgatgaaaacgatgggccatctcatcataaaaattcacacatacaaacatttttttctatgcaatttagagggtacccagccctagctaagaatctctgatctattgattaaaattctaaaataactaaaataatatgcatttatttatttatttatttattttgagatggagtcttgctctgttgcacaggctggagtgcaatggcacgatcttggctcactgcagcctctgcatcttgggttcaagtgattctcatggctcagcctcccgtgtagctgggattacaagcacgtgccaacacgcccagctaatttttgtatttttagtagagacagggtttcaccatattggccaggctggtcttgaactcctggcctcaagtgatccacccacttcggcctcccaaagttctgggattacaggcatgagccaccatacccggccccaatatgcattttcttagtgcctgaaagctacgatgacatgggcatgaaatgggcccagtgcagactacatgtgtgagaagagacttccttcaggccagcacgacacttcttccctatggtcacaagtgcctttttcctctttgtgtaacaactcctctctaaccatctgcagtttgcatgtgttgaaccaaaccctaactccaaaaacttaggtctggtcagttgaaacctcccatttatttggctacagtgatgggtttggggatggatatgtgaccaaagtcagtgagtgagactcaattccaggactctcttgagactactgggaaaaacaatgctatttctgttggagtggttgagaggccatgatgtaagccagggattctcaaccagtggtgatttcacctcccatgggacatttgggaacacctggagacatttttggttgtcacttctagggatgtgctactgacatgtattgggtagaaaccagggatgcagttgaacctcctacaaatgcatgggacaaccatccccaacaaagaattattctgccacaaatgccaataatgcagaggttgagaaacgcttctgtaagcttagagtttgagcaactattttggtgttgcataaaatgagcctgcccaagactgaggccaactgaaaggagataaagctgagagatggaggaagggcaagtcatgaagatgtcctttgagatctgggatgcatctctgtctgaagttgagccctggactttacaaaactgtatcatttacaagtaattgcttcctgattcagccttctgttgattcaacaacacatgttcgttaggtggctgccaggtgccaggactcttactttcattgagttataccagcaacgatgttaatgagaaacaaataacacagataaataaagaaaatagaactgggaatggcggattgcatacagaggctaattcagatgaggaggaaactggaaatcaacaacagaacatcctccgtgtgcatatattgtggtctatgatgtatgaaaatgtaaagtacatgatatttggtgctcctgaaagagtgtggctgcagtcacagtcatcaaatccttgcagtgtcttcacaaaatctcaagttcagaacccctctaggattgctatgtaggtactagtatagaagagagcatttctgatctgtaaagagaaaacatgcaggattctgccttcagatggcattttatttcctggctgggggcatgagacagacttttggtattgaaggactttgactcctagatgctggcaaggctgtggagaaatagaaacgcttttacactgttgctgggaatgtaagttaattcaaccactgtggaaggcagtgtggcaatttctcaaggatctagagccagaaataccatttgaccaagcagtcccattactggatatatacccaaaagattataaatcattctgttataaagatgcatgcacacatatgtttattgccacactatttataatagtaaagacttggaaccaacgcaaatacccatcaataatagactggataaagaaaatgtggcacatatacaccatggaatactatgcagccataaaaaggaatgagttcatgtcctttgcagggacatgggtgaagatggaagccatcattctcagcaaactaacacaggaacagaaaaccaaacactgcatgttctcactcataagtgacaattgaacaatgagaacacatggacacatggaggggaacatcatacaccagggcctgtcgggaggtggggggcaatgggagggagagcattaggacaaatacctaatgcatgcaaggcttaaaacctagatgacgggttgataggtgcagcaaagcaccatggcacatgtatacctaggtaacaaacctgcacgttctgcacacgtatctcagaacttaaagtaaaatttaaaaaaattaaaaaataaaataaaataaaaataaaacgattttgacaccacgaaattgctgagtcctgaaagagaacaaatggttctgtgcagaccaggcactacagagaggtgcagagctgaggggcaaatgaaggctcacatggagcccaagctcccatcacccagtcttgcacttgccttgagtgtgtgtaaccccagggaggggcacattgttatgaattatttgcccagagggtttgtctgccctgagcaagtgcctttacttatttacacaaaggggtcctctgtgctgggtggtagccccactggtggaagctgtagtgtgccccaatctctcttctcatgccttctccatagtcacagagcaatgacagcattcttctggccccttgctgtcagatgcaggcactgcctaccatctgatcaatggggagtaatcacacatgccatgcagcagcttatagggacttccctaagggacatctgtcacatgctttttgtccctgttctttatcctttcctcattagtgctagctggactgcagatgttattcaaccaaagacacatgccctgatgaaacgcacacggggcctgctggggaagcacttgttggagaaaactccaggagtcaggagcagaagtgagcatgtggatcacctgttggacataatggttctgcagcagtgcacagagggcttacagggcctggcatctgactgtgggagagggacttaacccttaggagggttttaaacttatgtctcctagaaagactaggagtttggatccaacagcagtaagaggcagcgggacctgtctctggtttaattccatcagctcagattcatggctgaggaacactcattccatcccttggtgaaccagggtttgaagtccaaaccttgcagtctcagtttccatgacatggcagatgggacctgatttgccacctcgagcactcagctgtaccaactcagacaccaacttgtgggaaatcagtcttgaaaaagacttgtagcctgtgttggtcagttgttccaacacaagtctcagagttgctctgtgaaggtattctgtagatgtggttagcatcaacaatcagtttgctttgagtaaagaagattatcctttttagcctgggtgggtgggccatgttgaaagacattaagagccacactgagaaagaagaaatgctgcttgtagatgacaatgtcagctcccaccacagtttccagcctgctagcctaaggatttcaggctttcccagccagacccccaattccttgaaataaataaatatatatcttactggttctgtttttctggtagaactctgatacctagtgcaagtccaacttggacttgcttttccatgaatatgttggaattagagcatctatgtttgaccagcataactatgcacaggggagcaacaagataacaaagatcctggatcttcttaccctgcggatccacaatagcccttggccatacacctctggatttttacacagaaaagatgcaaacttctacctcaatgaagccattgtttttcttctctcatagcaaacttaatcctaagtaatgtatatttattgggtgactattatttgctcaacagataaggaaagagaacttctgaggaactaaatgacatacccaagatcacgcaaccagcaagtggtaggaataaatgcacgcctgtggggtttgaaagcccacactatttgaactacaaaatccagaatttcagggtcccacttatgcttctacaacagcccttttacatctaggcgtggggggaatatttccttaagcaatagtctttggcttcagaaaatctgagcgtcgtcatatactttcacaatggaatgagagaagagccagccaaaggtatttcagaagcagagagagcactttgcagatttaaggtctaccaaggctatctcagcttagccattcttcaggtctaacgcgatgtactaggttagacagaagtcacaggccgaagtccagagaaaacaagatgcatcagtcactgtgtaactatttattgctgtgtaacaaatttctccataaacatttattatctcacagttttggtggatcaggcattcagaagcagctcacgtgggtggctggtggctcagggtctctcatgaggtttcagttaagatgttgaccaagactgaggttacacgaaggcttgactggggctggagaattggcttttgacaggaggcttcatttcctcatcccatacacttctctgtagggctgcaagtcttcatgacatggcagtctcttcccccagaataagtgatgcaaagagaaggccacgctgccttctatgacccagtcccagaagtcacacactgtcacatctgctatattctattcattaaaagcagatcattgggtccaacctatacaaaaagggtggggaaattaagctccactcttgaaaagaggaaaatcataggcgacccatattagaacaagacagaattctgcacagactttcatcaacaataactaaccaacagagggcatttggcagaggaagcaaaccttctgtggaataacgaaacctacggtacagagagtgaactctcagccacctcccaggaggacatgaaacatcctctgcagagaacaattagagtgcagcacatttcacaacattgctgaacactgctccaacaggggcatgctcctggtggaagcaaaactggggctcagcttccatcctaggcctctggacccgtgatgggaagggttctttttccatattatttaaaaaataactaaagtcaaagggacattgtatatacagaacagtgtttgaaatgaacatgtataaccaataaagaaaacactaccacaaagagaattagaacattgccaggctcttaaaagatctgattctcccttcttaaccccatccctcttcttcccgttgagaggtaatcactatcttggctttggaataatcattcccttgcttttcctcgtttttttgtttgtttgttttgcttttttcactaccattgcatgacccctaaataatatattatctttctctgctttcaaaatgtaaataaatggaaccatatcatatatgttgtcctgctacatgcccctttggtgcgacagtgagtttgttagtttcattaattgctgtataaactccattatgtggatatacctgcattggctaatccaatctaatgttgatggattcttggttgatgaatgctcatgaaaaaatttcttttttctatatgcatgacccaatcacctcccaccaggccccaactccaacactggggattacaactgaacatgagatttgagcagggacatagatccaaactgtatcagacttttttttattaactttaattttgagttcaggggtacaagtgcaggtttattacatagataaacttgtgtcatgggtgtttgttgtccagactatttcatcactcaggtattaagcctagtacccataagttatttttccagatcttctccctcctcccaccctccccgctctgaaaggccccagtgtgtgttgttcccctctatgcgtccatgtattctcatcatttagctcccacttataagtgagaacatacggtatttggttttctgttcctgtgtgagtctgtgaaggataatgacctccagctccatccatgtccctgcaaaggacatgatctcattctttttatggttacatagaatttcttggtgtacatgtaccatattttctttatccagtctatcattgatgggcatttaggctgatttcatgcctttgctattgtgaatagtgctgcagagaacactgaggtgaacatgtctttataatagaatgttttatactcctttgtgtatatacccagtaatgggattgctaaatcgaatggtatttctgtctttaggtctttgaggaatcaccaccctgtcttccacaatggctgaactaattcacactcccaccaacagtgtataagcattcctttttattcacaaccttgccagcatctgttattttttgactttttaataatagccattctgactggtgttagatggtatcttattgtggttttgatttgcatttctctaatgatcagtcatgttgagctgttttttcaaataattgttggccacatgtatgttttcttctgaaaagtgtctgttcatgacctttgctcactttttacaagggttgtttcttttctttgtaaagaaattaataaatttaagttccttatagatgctggatattagacctttgttagatgtatagtttgcaaaatttttctcccattctgtagattgtctgtttactctgttgatagtttattttgctgtgcagaagcttgttaattagatcctatttgtcaatttttgcttttgttcagttgcttttggcatcttcatcatgaaacctttgcctgtgcctatgtcctgaatgatattgcctaggttgtcttccatgatttttatagttttgggttttacatttaagtctttaatccatcttgctttaatttttgtatatggtgtaaagagggggtctagtttcaatattctgcatatgacttaccacttatcctagcaccatttattgaacagggaatcctttccccattgcttgtttttgtcacttttgtccaagatcagatggttgtaagtgtgcagtcttatttctgggttctctattctgttccattggtctatgtgtctgttttttgtaccagtaccatgctgttttggttactgtagccctgtattatagtttaaagttgggtagtgtgatgccttcagctttgttctttttgcttaggactgtcttggctattcgggctttttcatatcagactttttaatgtttgacaatatggtgggtgcaaaatagatattattttgattttaatttatatacccttagttaccatgagcttgagcattgtttataattaattgttcatcatgtttccactcttgaaaagtgatctattcaattcttttgcatatttcccaccgtttttacttgttgatttacaatagttaaacattttggttactagtgttttgcaggtgatatgagttacaaaactttctcccagcaggtagtttatcttttcactctctttaatgatatattttaatttaaacacccttaatgttaatatagtaatatctatcaatatttcttttacaggttgtagtttttatgtcttgttttataaaaccgttttgcacctcaaggtcatattctcctgtaataccttctaaaatgctttataagtttaaattttacatttaaatccttaatcatatatgtgtgactgatttttacatgtggtattatgtaggggtccaattaattttccccattataaagatttctagttgtttggcctcatttattgaaaaatccactctttctgagttgatgtttagtactatttctgattatatcaagtatgcatatctgttagattagtttatggactttcctattccattgttgtgtctcttttgagccatccatactgttattcttaattacaataactttataataagatttagttcctaggggaacaaaaaacacaacacatgtgctgtgctttcaagcatagctgggcctgtgcaatctggccctctgtgtaattttaaaaacagcttgtaaaaaaaaaaatgtactgccggattttttttttcagaggaattgcagtgggtttctagattatcttgcaaacaatagacatctttataatatggaattattaaatccatgtacatgatccatcacttcatttgcttacgttgtctttaatgtttttaaatgaaggtttattgttttcccataaagctcttgcatatctttatagaattattcttaggtattacatttttatgctattgaaaatgatatatttttaaatttaaccttctcaatgtatatgttagtatgtaaaaatgcaattgaattttgattccaacaattttgctaaaactcttaaataaaattcaaaaattaacctaatgattaattagaattttatacatgcacagccatattttctatgaataataatagatttgtttcattccaatacttaccatttttatttcttttttccttaccatagtattctggtgagcctccaaacctatgttgaatagtaagcatctttttcttgttcttgacagcaaagaaaatgcttttaattatatagctttatgtgaaatatttgctatacattttctatagacactattatcaagttaaagaagtcatattcttttcttagtttgctagtagttaataagatatagatgcttaattttactttctatatgtattcagataatcatacttttttcctataatgttttcatgtgggggatacattaattgatttcccgatattaacccaactttgcactattttgatcaacccaccttgatcatgatataatttctttcttatacatggctgaattctccttatgaatatttggttaaaatttttgcatcttgcattcataagaataattggcctttttttgtactgttattgtttttggcatcaaagttatgttagcctacaaattttaaaaattttattggggagtattattcttttttatattctccaccatattttgggaaattttggaccttaaatatttgattgacctaactgatgaagccatctgactttagctttctttgtgggaaaagctatgactatgaattcagtttctttaatggctgtaagatcattcaggttttctgtttcttcttgtgtcagttttgctaggtttgttttctacacaaatttattcatttaatatacttttcaaacaaataggcataaagtagttcacaacatcttctaatcatttgaaagtctttagcaaccatagacttatccccatttttattcttaatattatctgtcttttcttttttaaagtactctcactaaagacaagatttgtccattttattaatcttttaaaaaactccaatttttatctttgttgattctctgtattttcagttgttcaatttgttaatttctgttatctttataatatcccacttcctaattgtttttatttgttttttgtttgttttgctgcctttttgccaactttttaaaatggatgcttagtttactaattatcatccttttttttctatttcaatataaatatttaggactataaatttctatttgctgttttagctgtataccacaaattttatatgtattttattatattaaatcatattgtctaaattacattgtaatttcttttttgaaacgttagtatatttcctaagtaaatttttctacttaacttttaattgacatctagcataattactttaggtctgagtaggtattatattattttagtcatttaaatgtgttgtgattttctttataaacctattcatggtaaatttgtaaaaatgattcatgtgtaagaatttgtattttttagttgttgggagcagtactctaaccccattaagtcaagtttgttaatcttccatttcttgttttttttttcacctgttttatcaatagctcacacaactatattaaaaagtaggtatgaatgtagtgcaagaaattattttcttcttgttataaaatcaaaatgaaattgactccaccaagaattggtgagaattttgaatattttaatgtcatcatcattgtgagttctgctctatccatagatcctggaagcaaaagtcttctggtcctcagtgcacactctttgctccaaaccctataggttgtggtttcagtgtcaagtaaaggtacagggatccctgatggggctagaatctgcataaccaaggcttcagctccctggcagagccacactctgaattcctgtaagtatccaggacttaaacattcataatggtctaggtccccattgcttgtgaatcctatagactctaatcttttcccattaatgggataacttctcccaacatctctctcgttttgctactcttcttattgtttccttttacattttgttttcaaaaatttccccaagaactttgagaagttcaatttaaactactctaccttgggcttgagggtggaggaatgagatgctgagacgtaagatctggtaataatgcctacaataggcatatttccctccacagaaaggtcagtacctctgtaaatatacaaaccaactgcctggcttcctgtttttttctgtatcacgttcttgtagtaccattgagaaagtagcactgggaggttgaaaatgtacctggctagcatccaagtcctgggtctgagttcaagctctgcttttcactagctacatgttttaagatgtatattaccatcttggagtctctacttctcatcttcaaatggggacaggaattctgcaagactctgaggtctacaaagtcagggcctgtgttctatttctttttgtattccttgggcctaattccacatctactattgtagatcaaatctttgttgtgaatgaaagaataaataaatttctgtcttcaagattttttgctatgatgaactgagacagcacatgagtaagctctttgtaaactatttttttttaagcacatgaaaaatgtatattgttattgtcacctttctattatatttcacagcaatgtgagatatcctcaaatatgcttttacatccctcatcctcaaatgtttagatcatcccccaatatttacatatttttcagcaattgtttaatataatctctacccaaggaagagatagaagccacttgaaaaaaagtcttagggacatctcccaaaactgcttattatttgaatggcttatattttaaaatgtgtgcagccaatttttcgctctcttgtgctccaacccttcttcataccacaggctgtgggcgtctgccccacagaccctgacccaatgacagatgaataatgtacactgacacacagatattctgctttgccagtccagctaagtgtctcagctgcttacagactccctggagagtactgtaaacagttgtcgaccagctagtgagacttacatttatttggtaaagattaattgacaaaggctcgagtcaacaccactacagggtaattgacaatgtggacttcccgagtagaaagcaattaagcacctgtggtaaatcaaaggttagtcttaagaccacatgagtaaacaagctagctagaaaaactctccacattcctttgttactactttaatatatttaactaaaggtaaagggaccaggccaccttcagccagatctattaccgaagttatgcaaactctcaggccttccaagagagtctgtggctgttactataaccatctttaatatttttcccaccagcctgattgaacccctacaacagactatggtaggtcagacccagaagtgccaagacttttcagacatggtccacaggtgtagcaagatgccccaagccccactcctcagtattttttggttcattaaatacaaaaaatgaacgttgtacttggccttatattgttttttaaaccacagactgcttgggttttgttttgttttgtttccatcactagtatgttttgctcctgaagattgttttctgaccccatgcctttgctcaagaaaagaaaaaattccctgcctggaatgcattctattcatcaaaacccttccctttctgaaatatcacctccttcaataagcctttcctgctcagcccactatatgagtatgagtatcctcatactcagaagcagctcacacatgctaagctgccctactccaattaagaagaaaatactaacacagcatctatagctttcattcaaggaaggctgagtacttgttaagatcattttttctaagttcacttagctgttaaagcagcaagggcaggatttggatcaggttctgtttggttccaaacccaccatgaggagccactgtgctgttttacctctgagaaagacctgacttaaaacccgacctctatgttatgagagtcaggctcctaggatggggaaccacgataggtgcatgcatgtcttgtcttgcattagagatttttatgtacattttccctttctagattataatctctccaagggcaagaactccctaacacctttctgtacctcttacatcattgtgacatcaaagattcttagcaaatgcttgttaagtaaatgagagcagacattcttgctccccactgattttatcttggatgctaataatacagtaaccttatttccaaaaaccattcccacagagcccgacacaccgtggaacaaaaactgagaattggattgaagaactggattgagaaaaggaaacactttggtgaaatcacaacctgtaaacagacctcaaaacatagtgttcactcaactgaagctgaacgttctatagcctgggttcatttggcttgattgcgcatcacttgtttacttggtgtgtataacactccacaggagtcacagggtccttttataggcatctctggtctgttgtgggccccgggtagtcatagtcccactgtcttgctcattatcctcctgcacccccaacacaactggacatcacacactaacttaacaattcagcctccttccaactgtcttaccccttctatctagtttcttcctgccttaattaacttcctagcatcatatgaataatcatttgtttgtttgctcatcctattgtggttgcccatcctatgatcttaacaagtactcagccttccttgaatgaaagctatagaccctctgttagtattttctttttaattggggtagggtggcttagtgaacatggacctgacagtgttggtttaaaatccagtgaccattgcatagttccactttaaaatgccctatgtcacattagtgtgaatgcacagaggcacagacaggcccagggtctcaggttagaaaatatgatgaggggaggggtttcttctaaagagaactgtggaattgtcggatgtgaatctgggcctgttgttcgtttctcgctatgcatgtttccatgggacggacactcagttgttactctcgctctctcccaccacttccgctctctttcacaggaagaggcgggtcctaccctgatggaaaccggttctggtctctgtccaatgggagtcgcttcctgtcctgcaccttcccaaccacatcagtgaaagggtggaagtgctggtctgcccactgcaggcttaacccatgttcttcctactaggaaagggacgtttccattttcatccacctgactcccgagttggttgcaaagatggaagaaaggaacagccatttattctcctggaggcaggccctgccggacttgagagggcctttcctctgaccctaagcatcagagcggatggagacagaaaatcctgaggccgctgtatggtgggtctcttcacagccatggggcccagccccactcgcctccaccaggttatggcccagcagctgggactccgtccagaagagcacctgcagcacgtatcctgtgttctccatcaaagcggcctggagtccgcctgcgtccccagcaagcagcactcccgccctaaaaccaaagggcgcagcaaggaaatgggagggctgcgctttgcttcctgtctgataactaccaacaaccgggcttctgcccagcatagctagataaggggagggcactccatttgacatgccctgaagactgtccaagcgatggcttaggaaggccattccaatttcaagtcctgaaagctgtaagatttttctgtgacttagagtgatttataacatagtttaacctctcaaagcttcacatctgtaaaatatggataaaactatctcaaagcggtattgtgcaagttaaatgaaaaagatagtgtatgcacattgtttggcactaagctattattattatcaaaagtagtagcaattagtattattgtttaaaggagaaaatgatatccattgggaggctcctctttggacctgaaagcttaatatctggaattacttagaactggaatgccagcctccgcctcctgccagcagcctgctgccaattctgatgagacagcttagaaaccattgccctgatgccatagaaaagaagaggacagctagccttttcctttctcttcacccttaatttaaaaaggttgggcaagttacacatccacccacctccaaacctttcaaacaagtttcagttatattcttgccgagtagaaaaaccaaaaattaataagagaacttacttaaaataaaaagttgttaacatcttgatacatcctggctttccagttaagagactttacagaatggttcgtgacttctacaccaaattctttcttgtatattttgtctacaccccaccccttccttagcctcaacctcatgagtgcaaatggagatcagccctggctcctggcatcccacgacgacttggaggtggaaattgttagtctggagtgggattgagggcccctgaggcagactgacactctttcagctgatgcatgtctaatgctgagcaggctgtgaccaaccaccctcaggacatgtttttatgcaagtgtgctgtagggggtggtcttcctcataagtgagaaaacatgaaagcaaagttcatttatcccatcagttggctgcttctcaccattcacctgggccctgcagtgctgagaaaataggatgtattttaatctccaagcagactggactccaatcaatttagagacacagagccacaacataattcaatttggggtgattccactgtctctgtaatgtctaaagccctaatgtactgctgactcttaggacaaactggcactgatcaagagtgaggccactaagccatcactgatttcagactctcacccctgactttctatgtatggacaacacttaatatttcacagaacccaagttgcactggaccgaagaagacctaaatagccatgtagtccatgtgctgccaaacacctggcaaatagttgcatggttgttaaataagcacacctcatatccaggaactcctggacaaaggctgaccattccatctggacctcctccaacttctaaaaagctttctcttgaatttggccaatgggcatccctgctgagcccacctttagtccagatgttacctttctggatgttcattcatgcatatagctgcaaacgttttccaacagcttgatattgctaggcactgtgctgggtcctgaatcaatgggtgataagggtaatcccactttcagcagagacactgacagcccctacttgacatggtcctgggttctctcattccccttgtctctccccactgaacctgcactaactgtcctatgtccctctttaagtgtaggcccagaattgatgttgcagtctaatgtataacaaataagtcctcgtttgtgacctgtttcagaaaatgcaacctaagattgggcagtcatgtcaccttcccgtttaattttctgtccatatgaggcaaaatagcttaagattaagaaaaagcttttggaattaactagccctggaacaagcatttgttgcacctcttacgctgcagagctgggcaaattgttcaatctgtcaagacatttttttaagtgtaccgtaggggcagttggaaggagtaatgaggcagtgtgtatacagcacctgacctagtcatggctcattaaaagctgctattctacatctcattgctgtcatctccaaaacgctgaagtcttttcacatgtgctgctgctccatcaaactcccagatgttttggggaggactggatggaggtcctaacaccttcaagatctaacccgtcacctcagcctgttctttggcatcctggatgtgtcacataacctattgtcatctcagccccatggcatttggagctgagatcaggatagcttctgtatcctcatctgagtaaagtatgaccaagtaagttcaagggccgcagcctggggtttaatcctgcgacctcccttctagacgagcatccattttttaattagtactgtttggctgtgcttattcaatgagtcatgagtcataaacttgtaacatctccagattgttttatgaagtcatatcaggatgaaattctgcctacctactatttctgtattatcttctttaggaaacatgccatgtggctacagaacatgaaaaaaccattttttttttccataaagtttctacatataacatgcttcctgcagaagtttgtaattcacatattctagcactaattataatcaggtaatattatgactttctccaacagaataatagtttaacatttttttgtgagaagataatgatgttttactcagtaaaatgagtttaaaattacaagttagaaaagtttatctagttgtttctatatagcattaatctgggctgctttgtcaaaaatttattttatttttgaatcagggtgtcactctgtcacccaggctagtggcgtgatcacagctcactgcagccttgaactcctgggactgcagttgtgcaccaccatgcccggctttttgtatttatttatttttttgtagagactgggtactctcatgttgcccaggctggtcccgggctcaagcgatccacccgcctctgtccttcaaagtgttgggattacaggtgtgagtcaacaagatttctttaaaccaaggttaaaagataaaaagaaggcacagaatttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaa
